US009913822B2

(12) United States Patent
Maneval et al.

(10) Patent No.: US 9,913,822 B2
(45) Date of Patent: Mar. 13, 2018

(54) COMBINATION THERAPY WITH AN ANTI-HYALURONAN AGENT AND THERAPEUTIC AGENT

(71) Applicants: Daniel C. Maneval, San Diego, CA (US); H. Michael Shepard, San Diego, CA (US); Curtis B. Thompson, San Diego, CA (US)

(72) Inventors: Daniel C. Maneval, San Diego, CA (US); H. Michael Shepard, San Diego, CA (US); Curtis B. Thompson, San Diego, CA (US)

(73) Assignee: Halozyme, Inc., San Diego, CA (US)

( * ) Notice: Subject to any disclaimer, the term of this patent is extended or adjusted under 35 U.S.C. 154(b) by 0 days.

(21) Appl. No.: 13/815,804

(22) Filed: Mar. 15, 2013

(65) Prior Publication Data
US 2013/0302400 A1  Nov. 14, 2013

Related U.S. Application Data

(60) Provisional application No. 61/686,429, filed on Apr. 4, 2012, provisional application No. 61/714,719, filed on Oct. 16, 2012.

(51) Int. Cl.
| A61K 47/48 | (2006.01) |
| A61K 31/56 | (2006.01) |
| A61K 31/7068 | (2006.01) |
| A61K 31/337 | (2006.01) |
| A61K 38/47 | (2006.01) |
| A61K 31/37 | (2006.01) |
| A61K 31/42 | (2006.01) |
| A61K 31/573 | (2006.01) |
| A61K 31/706 | (2006.01) |
| A61K 31/7076 | (2006.01) |
| A61K 31/7088 | (2006.01) |
| C12N 9/06 | (2006.01) |
| C12N 9/26 | (2006.01) |
| A61K 45/06 | (2006.01) |
| A61K 9/00 | (2006.01) |
| A61K 47/60 | (2017.01) |
| A61K 47/56 | (2017.01) |
| A61K 47/64 | (2017.01) |

(52) U.S. Cl.
CPC .......... *A61K 31/337* (2013.01); *A61K 9/0019* (2013.01); *A61K 31/37* (2013.01); *A61K 31/42* (2013.01); *A61K 31/56* (2013.01); *A61K 31/573* (2013.01); *A61K 31/706* (2013.01); *A61K 31/7068* (2013.01); *A61K 31/7076* (2013.01); *A61K 31/7088* (2013.01); *A61K 38/47* (2013.01); *A61K 45/06* (2013.01); *A61K 47/48215* (2013.01); *A61K 47/48284* (2013.01); *A61K 47/56* (2017.08); *A61K 47/60* (2017.08); *A61K 47/643* (2017.08); *C12N 9/003* (2013.01); *C12N 9/2474* (2013.01); *C12Y 105/01003* (2013.01); *C12Y 302/01035* (2013.01)

(58) Field of Classification Search
None
See application file for complete search history.

(56) References Cited

U.S. PATENT DOCUMENTS

| 2,488,564 | A | 11/1949 | Singher et al. | 435/201 |
| 2,488,565 | A | 11/1949 | Singher et al. | 435/201 |
| 2,676,139 | A | 4/1954 | Tint et al. | 424/201 |
| 2,795,529 | A | 6/1957 | Album et al. | 424/94.3 |
| 2,806,815 | A | 9/1957 | Orlando | 435/188 |
| 2,808,362 | A | 10/1957 | Thompson et al. | 435/201 |
| 3,350,388 | A | 10/1967 | Frantisek et al. | 536/28.3 |
| 3,536,809 | A | 10/1970 | Applezweig | 424/28 |
| 3,539,794 | A | 11/1970 | Zaffaroni | 240/2.25 |
| 3,598,123 | A | 8/1971 | Zaffaroni | 424/435 |
| 3,630,200 | A | 12/1971 | Higuchi | 424/427 |
| 3,710,795 | A | 1/1973 | Higuchi et al. | 424/424 |
| 3,817,980 | A | 6/1974 | Vorbruggen et al. | 536/28.3 |
| 3,845,770 | A | 11/1974 | Theeuwes et al. | 424/427 |
| 3,916,899 | A | 11/1975 | Theeuwes et al. | 424/424 |
| 4,002,531 | A | 1/1977 | Royer | 435/188 |
| 4,008,719 | A | 2/1977 | Theeuwes et al. | 424/427 |
| 4,044,126 | A | 8/1977 | Cook et al. | 514/180 |
| 4,179,337 | A | 12/1979 | Davis et al. | 435/181 |
| 4,209,613 | A | 6/1980 | Vorbruggen | 536/27.11 |
| 4,364,923 | A | 12/1982 | Cook et al. | 424/46 |
| 4,414,209 | A | 11/1983 | Cook et al. | 514/180 |
| 4,687,660 | A | 8/1987 | Baker et al. | 424/465 |

(Continued)

FOREIGN PATENT DOCUMENTS

| CN | 102065886 A | 5/2011 |
| EP | 0272891 | 6/1988 |

(Continued)

OTHER PUBLICATIONS

Chica et al. Curr Opin Biotechnol. Aug. 2005;16(4):378-84.*
Sen et al. Appl Biochem Biotechnol. Dec. 2007;143(3):212-23.*
Liao et al. Eur J Radiol. Dec. 2011;80(3):699-705. Epub Aug. 31, 2010; PTO 892.*
Kadhim et al. Cancer Res Apr. 15, 2010 70; 5392, Abstract.*
Frese et al. Cancer Discov. Mar. 2012;2(3):260-9. Epub Feb. 28, 2012.*
U.S. Appl. No. 13/999,454, filed Feb. 26, 2014, 2014-0199282, Jul. 17, 2014.
U.S. Appl. No. 14/120,224, filed May 7, 2014, 2014-0248237, Sep. 4, 2014.
U.S. Appl. No. 14/323,932, filed Jul. 3, 2014.
U.S. Appl. No. 14/459,876, filed Aug. 14, 2014.

(Continued)

Primary Examiner — Christian Fronda
(74) Attorney, Agent, or Firm — Dentons US LLP; Stephanie Seidman

(57) ABSTRACT

Provided herein is combination therapy containing an anti-hyaluronan agent, such as a polymer-conjugated hyaluronan-degrading enzyme, and a tumor-targeted taxane, and optionally a further chemotherapeutic agent such as a nucleoside analog. The combination therapy can be used in methods of treating cancers, and in particular solid tumor cancers.

35 Claims, 8 Drawing Sheets

(56) References Cited

U.S. PATENT DOCUMENTS

| | | | |
|---|---|---|---|
| 4,769,027 A | 9/1988 | Baker et al. | 424/493 |
| 4,808,614 A | 2/1989 | Hertel | 514/45 |
| 4,942,184 A | 7/1990 | Haugwitz et al. | 514/449 |
| 4,952,496 A | 8/1990 | Studier et al. | 435/91.41 |
| 4,960,790 A | 10/1990 | Stella et al. | 514/449 |
| 5,015,744 A | 5/1991 | Holton | 549/510 |
| 5,033,252 A | 7/1991 | Carter | 53/425 |
| 5,052,558 A | 10/1991 | Carter | 206/439 |
| 5,059,595 A | 10/1991 | Le Grazie | 424/468 |
| 5,059,699 A | 10/1991 | Kington et al. | 549/511 |
| 5,073,543 A | 12/1991 | Marshall et al. | 514/21 |
| 5,120,548 A | 6/1992 | McClelland et al. | 424/473 |
| 5,122,614 A | 6/1992 | Zalipsky | 548/520 |
| 5,171,081 A | 12/1992 | Pita et al. | 362/101 |
| 5,200,534 A | 4/1993 | Rao | 549/510 |
| 5,323,907 A | 6/1994 | Kalvelage | 206/531 |
| 5,324,844 A | 6/1994 | Zalipsky | 548/520 |
| 5,352,805 A | 10/1994 | Kingston et al. | 549/510 |
| 5,354,556 A | 10/1994 | Sparks | 424/419 |
| 5,401,838 A | 3/1995 | Chou | 536/28.1 |
| 5,411,984 A | 5/1995 | Kingston et al. | 514/449 |
| 5,426,183 A | 6/1995 | Kjell | 536/28.55 |
| 5,439,686 A | 8/1995 | Desai et al. | 424/451 |
| 5,446,090 A | 8/1995 | Harris | 525/54.1 |
| 5,464,826 A | 11/1995 | Grindey et al. | 514/50 |
| 5,521,294 A | 5/1996 | Wildfeuer | 536/18.7 |
| 5,591,767 A | 1/1997 | Mohr et al. | 514/413 |
| 5,594,124 A | 1/1997 | Chou | 536/28.4 |
| 5,606,048 A | 2/1997 | Chou et al. | 536/27.11 |
| 5,612,460 A | 3/1997 | Zalipsky | 530/391.9 |
| 5,639,476 A | 6/1997 | Oshlack et al. | 424/468 |
| 5,643,575 A | 7/1997 | Martinez et al. | 424/194.1 |
| 5,672,662 A | 9/1997 | Harris et al. | 525/408 |
| 5,674,533 A | 10/1997 | Santus et al. | 424/493 |
| 5,733,566 A | 3/1998 | Lewis | 424/426 |
| 5,736,155 A | 4/1998 | Bally et al. | 424/450 |
| 5,747,027 A | 5/1998 | Stern et al. | 424/94.62 |
| 5,766,581 A | 6/1998 | Bartley et al. | 424/85.1 |
| 5,795,569 A | 8/1998 | Bartley et al. | 424/85.1 |
| 5,808,096 A | 9/1998 | Zalipsky | 548/520 |
| 5,817,840 A | 10/1998 | Nicolaou et al. | 549/510 |
| 5,827,721 A | 10/1998 | Stern et al. | 435/201 |
| 5,900,461 A | 5/1999 | Harris | 525/54.11 |
| 5,919,455 A | 7/1999 | Greennnwald et al. | 424/178.1 |
| 5,932,462 A | 8/1999 | Harris et al. | 435/188 |
| 5,977,163 A | 11/1999 | Li et al. | 514/449 |
| 5,985,263 A | 11/1999 | Lee et al. | 424/85.2 |
| 5,990,237 A | 11/1999 | Bentley et al. | 525/54.2 |
| 6,022,985 A | 2/2000 | Authelin et al. | 549/510 |
| 6,054,569 A | 4/2000 | Benett et al. | 424/945 |
| 6,103,525 A | 8/2000 | Stern et al. | 435/326 |
| 6,113,906 A | 9/2000 | Greenwald et al. | 424/194.1 |
| 6,214,966 B1 | 4/2001 | Harris | 528/322 |
| 6,258,351 B1 | 7/2001 | Harris | 424/78.3 |
| 6,303,569 B1 | 10/2001 | Greenwald et al. | 514/1.3 |
| 6,340,742 B1 | 1/2002 | Burg et al. | 530/351 |
| 6,413,507 B1 | 7/2002 | Bentley et al. | 424/78 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,482,850 B2 | 11/2002 | Ali et al. | 514/449 |
| 6,495,659 B2 | 12/2002 | Bentley et al. | 528/425 |
| 6,555,518 B1 | 4/2003 | Margreiter et al. | 514/20.5 |
| 6,737,505 B2 | 5/2004 | Bentley et al. | 528/425 |
| 6,749,868 B1 | 6/2004 | Desai et al. | 424/491 |
| 6,828,401 B2 | 12/2004 | Nho et al. | 526/333 |
| 6,838,569 B2 | 1/2005 | Sharma et al. | 549/510 |
| 6,858,736 B2 | 2/2005 | Nho et al. | 546/290 |
| 6,982,253 B2 | 1/2006 | Joshi Hangal et al. | 514/49 |
| 7,105,330 B2 | 9/2006 | Stern et al. | 435/200 |
| 7,148,201 B2 | 12/2006 | Stern et al. | 514/44 R |
| 7,250,416 B2 | 7/2007 | Phiasivongsa et al. | 514/241 |
| 7,544,499 B2 | 6/2009 | Frost et al. | 435/200 |
| 7,767,429 B2 | 8/2010 | Frost et al. | 435/201 |
| 7,871,607 B2 | 1/2011 | Bookbinder et al. | 424/94.62 |
| 8,022,279 B2 | 9/2011 | Mayer et al. | 424/450 |
| 8,034,375 B2 | 10/2011 | Desai et al. | 424/450 |
| 8,058,424 B2 | 11/2011 | Ionescu et al. | 536/55.3 |
| 8,133,888 B2 | 3/2012 | Patel et al. | 514/232.8 |
| 8,138,361 B2 | 3/2012 | Ballatore et al. | 549/510 |
| 8,202,517 B2 | 6/2012 | Bookbinder et al. | 424/94.62 |
| 8,431,124 B2 | 4/2013 | Bookbinder et al. | 424/94.62 |
| 8,431,380 B2 | 4/2013 | Bookbinder et al. | 435/201 |
| 8,450,470 B2 | 5/2013 | Bookbinder et al. | 536/23.2 |
| 8,765,685 B2 | 7/2014 | Bookbinder et al. | 514/20.9 |
| 8,772,246 B2 | 7/2014 | Bookbinder et al. | 435/200 |
| 8,846,034 B2 | 9/2014 | Jiang et al. | 424/94.62 |
| 9,211,315 B2 * | 12/2015 | Bookbinder | A61K 38/47 |
| 9,278,124 B2 | 3/2016 | Shepard et al. | 424/9.2 |
| 9,284,543 B2 | 3/2016 | Wei et al. | 435/201 |
| 9,447,401 B2 | 9/2016 | Wei et al. | 424/94.62 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0170243 A1 | 9/2003 | Stern et al. | 514/44 |
| 2003/0220447 A1 | 11/2003 | Harris | 528/322 |
| 2004/0013637 A1 | 1/2004 | Bentley et al. | 424/78.17 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.62 |
| 2006/0104968 A1 | 5/2006 | Bookbinder et al. | 424/94.62 |
| 2007/0082838 A1 | 4/2007 | De et al. | 514/19.4 |
| 2007/0117744 A1 | 5/2007 | Desai et al. | 514/2.3 |
| 2007/0286856 A1 | 12/2007 | Brown et al. | 530/388.26 |
| 2008/0161382 A1 | 7/2008 | Desai et al. | 514/449 |
| 2008/0255035 A1 | 10/2008 | Trieu et al. | 514/8 |
| 2009/0123367 A1 | 5/2009 | Bookbinder et al. | 424/1.49 |
| 2009/0181013 A1 | 7/2009 | Bookbinder et al. | 424/130.1 |
| 2009/0214505 A1 | 8/2009 | Bookbinder et al. | 424/94.1 |
| 2009/0263483 A1 | 10/2009 | Desai et al. | 424/484 |
| 2010/0003237 A1 | 1/2010 | Keller et al. | 424/94.62 |
| 2010/0003238 A1 | 1/2010 | Frost et al. | 424/94.62 |
| 2010/0112077 A1 | 5/2010 | Desai et al. | 424/499 |
| 2010/0143457 A1 | 6/2010 | Wei et al. | 424/450 |
| 2010/0305500 A1 | 12/2010 | Lambert et al. | 604/82 |
| 2012/0020951 A1 | 1/2012 | Shepard et al. | 424/130.1 |
| 2012/0046457 A1 | 2/2012 | Kolla et al. | 536/28.3 |
| 2012/0171153 A1 | 7/2012 | Frost et al. | 424/94.62 |
| 2012/0213767 A1 | 8/2012 | Wei et al. | 424/450 |
| 2012/0294830 A1 | 11/2012 | Bookbinder et al. | 424/85.2 |
| 2013/0202583 A1 | 8/2013 | Jiang et al. | 424/94.62 |
| 2013/0251786 A1 | 9/2013 | Li et al. | 424/94.62 |
| 2013/0302275 A1 | 11/2013 | Wei et al. | 424/94.62 |
| 2014/0037613 A1 | 2/2014 | Bookbinder et al. | 424/94.62 |
| 2014/0105824 A1 | 4/2014 | Shepard et al. | 424/9.2 |
| 2014/0135682 A1 | 5/2014 | Frost et al. | 424/94.5 |
| 2014/0199282 A1 | 7/2014 | Bookbinder et al. | 435/200 |
| 2014/0248237 A1 | 9/2014 | Bookbinder et al. | 424/94.62 |
| 2014/0348817 A1 | 11/2014 | Jiang et al. | 424/94.62 |
| 2016/0051640 A1 | 2/2016 | Bookbinder et al. | 424/94.62 |
| 2016/0220690 A1 | 8/2016 | Shepard et al. | 424/94.62 |

FOREIGN PATENT DOCUMENTS

| | | |
|---|---|---|
| EP | 0329348 | 8/1989 |
| EP | 0376518 | 7/1990 |
| EP | 0400472 | 12/1990 |
| EP | 0576230 | 12/1993 |
| EP | 0577303 | 1/1994 |
| EP | 0712860 | 5/1996 |
| EP | 0822199 | 9/2004 |
| EP | 1064951 | 8/2007 |
| EP | 2359859 | 8/2011 |
| JP | 2002-537347 | 11/2002 |

(56) References Cited

FOREIGN PATENT DOCUMENTS

| | | |
|---|---|---|
| JP | 2003-518000 | 6/2003 |
| JP | 2006-265117 A | 10/2006 |
| JP | 2006-298892 A | 11/2006 |
| JP | 2011-519361 | 7/2011 |
| KR | 10-2010-0135291 | 12/2010 |
| WO | WO 1988/002261 | 4/1988 |
| WO | WO 1991/015498 | 10/1991 |
| WO | WO 1993/010076 | 5/1993 |
| WO | WO 1993/016059 | 8/1993 |
| WO | WO 1994/014787 | 7/1994 |
| WO | WO 1994/028024 | 12/1994 |
| WO | WO 1998/000173 | 1/1998 |
| WO | WO 1998/032762 | 7/1998 |
| WO | WO 1999/033483 | 7/1999 |
| WO | WO 2000/002017 | 1/2000 |
| WO | WO 2000/033888 | 6/2000 |
| WO | WO 2000/050059 | 8/2000 |
| WO | WO 2001/021135 | 3/2001 |
| WO | WO 2001/087925 | 4/2001 |
| WO | WO 2001/076640 | 10/2001 |
| WO | WO 2002/049673 | 6/2002 |
| WO | WO 2003/043631 | 5/2003 |
| WO | WO 2005/000360 | 1/2005 |
| WO | WO 2005/118799 | 12/2005 |
| WO | WO 2007/027941 | 3/2007 |
| WO | WO 2008/060651 | 5/2008 |
| WO | WO 2008/101448 | 8/2008 |
| WO | WO 2009/111066 | 9/2009 |
| WO | WO 2009/128917 | 10/2009 |
| WO | WO 2010/006059 | 1/2010 |
| WO | WO 2011/057034 | 5/2011 |
| WO | WO 2011/123393 | 10/2011 |
| WO | WO 2011/144756 | 11/2011 |
| WO | WO 2011/153010 | 12/2011 |
| WO | WO 2013/151774 | 10/2013 |

OTHER PUBLICATIONS

Letter/Written Disclosure of the Supplemental Information Disclosure Statement for the above-referenced application, dated Nov. 24, 2014, 2 pages.

Kultti et al., "Accumulation of Extracellular Hyaluronan by Hyaluronan Synthase 3 Promotes Tumor Growth and Modulates the Pancreatic Cancer Microenvironment," Biomed Res Int. 2014:817613 (2014), 15 pages.

Stern, R., "Hyaluronidases in cancer biology," Semin Cancer Biol. 18(4):275-280 (2008).

Halozyme Therapeutics, "United States Securities and Exchange Commission Form 10Q, Part I," for quarterly period ending Mar. 31, 2014, filed May 12, 2014, 55 pages.

News release, Halozyme Therapeutics, Inc., "Halozyme announces podium presentation on PEGPH2O at the New York Academy of Sciences," Published Oct. 9, 2014 [online], Retrieved from:<URL:halozyme.com/Investors/News-Releases/News-Release-Details/2014/Halozyme-Announces-Podium-Presentation-On-PEGPH20-At-The-New-York-Academy-Of-Sciences/defaultaspx [retrieved on Oct. 10, 2014], 3 pages.

News Release, Halozyme Therapeutics, Inc., "Halozyme Receives Orphan Drug Designation for PEGylated Recombinant Human Hyaluronidase PH2O for Pancreatic Cancer," Published Oct. 3, 2014 [online], Retrieved from:<URL:halozyme.com/Investors/News-Releases/News-Release-Details/2014/Halozyme-Receives-Orphan-Drug-Designation-For-PEGylated-Recombinant-Human-Hyaluronidase-PH20-For-Pancreatic-Cancer/default.aspx [retrieved on Oct. 7, 2014], 2 pages.

News Release, Halozyme Therapeutics Inc., "Halozyme Reports Third Quarter 2014 Financial Results," Published Nov. 10, 2014 [online], Retrieved from:<URL:halozyme.com/Investors/News-Releases/News-Release-Details/2014/Halozyme-Reports-Third-Quarter-2014-Financial-Results/default.aspx [retrieved on Nov. 11, 2014] , 7 pages.

News Release, Halozyme Therapeutics, Inc., "Halozyme's PEGPH20 Program In Metastatic Pancreatic Cancer Receives Fast Track Designation," Published on Sep. 3, 2014 [online], Retrieved from:<URL:halozyme.com/Investors/News-Releases/News-Release-Details/2014/Halozymes-PEGPH20-Program-In-Metastatic-Pancreatic-Cancer-Receives-Fast-Track-Designation/default.aspx [retrieved on Sep. 15, 2014] , 2 pages.

News Release, "Halozyme Resumes Patient Enrollment and Dosing in PEGPH20 Clinical Program in Pancreatic Cancer," Published Jul. 22, 2014 [online], Retrieved from the internet: <URL:halozyme.com/Investors/News-Releases/News-Release-Details/2014/Halozyme-Resumes-Patient-Enrollment-And-Dosing-In-PEGPH20-Clinical-Program-In-Pancreatic-Cancer/default [retrieved on Aug. 18, 2014], 3 pages.

International Preliminary Report on Patentability, dated Jul. 15, 2014, in connection with International Patent Application No. PCT/US2013/032684, 19 pages.

U.S. Appl. No. 11/238,171, filed Sep. 27, 2005, 2006-0104968, May 18, 2006.

U.S. Appl. No. 12/381,063, filed Mar. 6, 2009, 2010-0003237, Jan. 7, 2010.

U.S. Appl. No. 12/381,844, filed Mar. 6, 2009, 2010-0074885, Mar. 25, 2010.

U.S. Appl. No. 12/475,221, filed May 29, 2009, 2010-0015698, Jan. 21, 2010.

U.S. Appl. No. 12/653,245, filed Dec. 9, 2009, 2010-0143457, Jun. 10, 2010.

U.S. Appl. No. 12/660,894, filed Mar. 5, 2010, 2010-0284995, Nov. 11, 2010.

U.S. Appl. No. 12/753,046, filed Apr. 1, 2010, 2010-0184845, Jul. 22, 2010.

U.S. Appl. No. 12/807,991, filed Sep. 16, 2010, 2011-0066111, Mar. 17, 2011.

U.S. Appl. No. 12/928,890, filed Dec. 21, 2010, 2011-0152359, Jun. 23, 2011.

U.S. Appl. No. 13/068,025, filed Apr. 29, 2011, 2011-0212074, Sep. 1, 2011.

U.S. Appl. No. 13/135,817, filed Jul. 15, 2011, 2012-0020951, Jan. 26, 2012.

U.S. Appl. No. 13/200,666, filed Sep. 27, 2011, 2012-0108455, May 3, 2012.

U.S. Appl. No. 13/374,500, filed Dec. 28, 2011, 2012-0148555, Jun. 14, 2012.

U.S. Appl. No. 13/385,527, filed Feb. 21, 2012, 2012-0213767, Aug. 23, 2012, 2013-0101577, Apr. 25, 2013.

U.S. Appl. No. 13/385,528, filed Feb. 22, 2012, 2012-0171153, Jul. 5, 2012, 2013-0028856, Jan. 31, 2013.

U.S. Appl. No. 13/506,783, filed May 16, 2012, 2012-0251620, Oct. 4, 2012.

U.S. Appl. No. 13/506,844, filed May 18, 2012, 2012-0251517, Oct. 4, 2012.

U.S. Appl. No. 13/507,261, filed Jun. 15, 2012, 2013-0022592, Jan. 24, 2013.

U.S. Appl. No. 13/507,262, filed Jun. 15, 2012, 2013-0022588, Jan. 24, 2013.

U.S. Appl. No. 13/507,263, filed Jun. 15, 2012, 2013-0011378, Jan. 10, 2013.

U.S. Appl. No. 13/507,540, filed Jul. 6, 2012, 2012-0294830, Nov. 22, 2012.

U.S. Appl. No. 13/694,005, filed Oct. 18, 2012, 2013-0058893, Mar. 7, 2013.

U.S. Appl. No. 13/694,071, filed Oct. 24, 2012, 2013-0202583, Aug. 8, 2013.

U.S. Appl. No. 13/694,731, filed Dec. 28, 2012.

U.S. Appl. No. 13/801,940, filed Mar. 13, 2013.

U.S. Appl. No. 13/815,311, filed Feb. 19, 2013.

U.S. Appl. No. 13/815,553, filed Mar. 8, 2013.

Letter/Written Disclosure of the Information Disclosure Statement for the above-referenced application, dated Aug. 28, 2013, 3 pages.

Abraxane Product Information [online][retrieved on May 23, 2013] Retrieved from:<URL:medsafe.govt.nz/profs/datasheet/a/abraxaneinj.pdf, 15 pages.

(56) References Cited

OTHER PUBLICATIONS

Adams et al., "The c-myc oncogene driven by immunoglobulin enhancers induces lymphoid malignancy in transgenic mice," Nature 318:533-538 (1985).
Aduma et al., "Anti-herpes virus activity of 5-methoxymethyl-2'-deoxycytidine in combination with deaminase inhibitors," Antiviral Chem. Chemother., 1:255-262 (1990).
Alexander et al., "Expression of the c-myc oncogene under control of an immunoglobulin enhancer in E mu-myc transgenic mice," Mol. Cell Biol. 7:1436-1444 (1987).
Alexander et al., "Synthesis and cytotoxic activity of two novel 1-dodecylthio-2-decyloxypropyl-3-phosphatidic acid conjugates with gemcitabine and cytosine arabinoside," J. Med. Chem., 46:4205-4208 (2003).
Alexandre et al., "Novel action of paclitaxel against cancer cells: bystander effect mediated by reactive oxygen species," Cancer Res., 67:3512-3517 (2007).
Altmayer et al., "Propofol binding to human blood proteins," Arzneimittelforschung, 45:1053-1036 (1995).
Altschul, S., "Basic local alignment search tool," J Molec Biol 215(3):403-410 (1990).
Ansel, H., Introduction to Pharmaceutical Dosage Forms, Fourth Edition, Lea & Febiger: Philadelphia, PA, p. 126 (1985).
Anttila et al., "High levels of stromal hyaluronan predict poor disease outcome in epithelial ovarian cancer," Cancer Rearch 60:150-155 (2000).
Arming et al., "In vitro mutagenesis of PH-20 hyaluronidase from human sperm," Eur J Biochem 247(3):810-814 (1997).
Auvinen, P. "Hyaluronan in peritumoral stroma and malignant cells associates with breast cancer spreading and predicts survival," American Journal of Pathology 156(2):529-536 (2000).
Auzenne et al., "Hyaluronic acid-paclitaxel: antitumor efficacy against CD44(+) human ovarian carcinoma xenografts," Neoplasia, 9:479-486 (2007).
Baker et al., "2'-Deoxy-2'-methylenecytidine and 2'-deoxy-2',2'-difluorocytidine 5'-diphosphates: potent mechanism-based inhibitors of ribonucleotide reductase," J. Med. Chem., 34:1879-1884 (1991).
Barron et al., "A fluorescence-based high-throughput assay for antimicrotubule drugs," Anal. Biochem., 315:49-56 (2003).
Baumgartner et al., "Phase I study in chemoresistant loco-regional malignant disease with hyaluronidase," Reg. Cancer Treat. 1:55-58 (1988).
Baumgartner et al., "The impact of extracellular matrix on the chemoresistancce of solid tumors—experimental and clinical results of hyaluronidase as additive to cytostatic chemotherapy," Cancer Lett. 131(1):85-99 (1998).
Benhar et al., "Pseudomonas exotoxin A mutants. Replacement of surface-exposed residues in domain III with cysteine residues that can be modified with polyethylene glycol in a site-specific manner," J. Biol. Chem. 269:13398-13404 (1994).
Ben-Hattan et al., "An improved synthesis of 2'-deoxy-5-azacytidine by condensation of an 9-fluorenylmethoxycarbonyl-protected sugar onto the silylated base," J Org Chem, 51:3211-3213 (1986).
Bernoist, C. and P. Chambon, "In vivo sequence requirements of the SV40 early promotor region," Nature 290:304-310 (1981).
Bertelli et al., "Hyaluronidase as an antidote to extravasation of Vinca alkaloids: clinical results," J Cancer Res Clin Oncol. 120(8):505-506 (1994).
Bertelli et al., "Skin ulceration potential of paclitaxel in a mouse skin model in vivo," Cancer. 79(11):2266-2269 (1997).
Bertrand et al., "Hyaluronan (hyaluronic acid) and hyaluronectin in the extracellular matrix of human breast carcinomas: comparison between invasive and non-invasive areas," Int. J. Cancer 52:1-6 (1992).
Bissery et al., "Experimental antitumor activity of taxotere (RP 56976, NSC 628503), a taxol analogue," Cancer Res. 51:4845-4852 (1991).

Bookbinder et al., "A recombinant human enzyme for enhanced interstitial transport of therapeutics," J Control Release, 114:230-241 (2006).
Bordier C., "Phase separation of integral membrane proteins in Triton X-114 solution," J Biol Chem. 256(4):1604-1607 (1981).
Bouchard, J. and R. Momparler, "Incorporation of 5-Aza-2'-deoxycytidine-5'-triphosphate into DNA. Interactions with mammalian DNA polymerase alpha and DNA methylase," Mol. Pharmacol. 24:109-114 (1983).
Bouffard et al., "Kinetic studies on 2',2'-difluorodeoxycytidine (Gemcitabine) with purified human deoxycytidine kinase and cytidine deaminase," Biochem. Pharmacol. 45:1857-1861 (1993).
Bradley et al., "Tumor targeting by covalent conjugation of a natural fatty acid to paclitaxel," Clin. Cancer Research, 7:3229-3238 (2001).
Braunhut et al., "Detection of apoptosis and drug resistance of human breast cancer cells to taxane treatments using quartz crystal microbalance biosensor technology," Assay and Drug Dev. Tech., 3:77-88 (2005).
Breistol et al., "Antitumor activity of P-4055 (elaidic acid-cytarabine) compared to cytarabine in metastatic and s.c. human tumor xenograft models," Cancer Res., 59:2944-2949 (1999).
Brekken et al., "Hyaluronidase reduces the interstitial fluid pressure in solid tumors in a non-linear concentration-dependent manner," Cancer Letters 131:65-70 (1998).
Brekken et al., "Hyaluronidase-induced periodic modulation of the interstitial fluid pressure increases selective antibody uptake in human osteosarcoma xenografts," Anticancer Res 20:3513-3519 (2000).
Brinster et al., "Regulation of metallothionein—thymidine kinase fusion plasmids injected into mouse eggs," Nature 296:39-42 (1982).
Brumeanu et al., "Derivatization with monomethoxypolyethylene glycol of Igs expressing viral epitopes obviates adjuvant requirements," J Immunol. 154:3088-3095 (1995).
Burris et al., "Improvements in survival and clinical benefit with gemcitabine as first-line therapy for patients with advanced pancreas cancer: a randomized trial," J Clin Oncol, 15:2403-2413 (1997).
Cacciamani et al., "Purification of human cytidine deaminase: molecular and enzymatic characterization and inhibition by synthetic pyrimidine analogs," Arch. Biochem. Biophys. 290:285-292 (1991).
Caliceti, P. and F. Veronese, "Pharmacokinetic and biodistribution properties of poly(ethylene glycol)-protein conjugates," Adv. Drug Deliv. Rev. 55(10):1261-1277 (2003).
Carmichael et al., "Phase II study of gemcitabine in patients with advanced pancreatic cancer." Brit J Cancer 73:101-105 (1996).
Carrillo, H. and D. Lipman, "The multiple-sequence alignment problem in biology," Siam J Applied Math 48:1073-1082 (1988).
Carter et al., "Structure of serum albumin," Adv. Protein. Chem., 45:153-203 (1994).
Chabot et al., "Kinetics of deamination of 5-aza-2'-deoxycytidine and cytosine arabinoside by human liver cytidine deaminase and its inhibition by 3-deazauridine, thymidine or uracil arabinoside," Biochemical Pharmacology 22:1327-1328 (1983).
Chao, H and A. Spicer, "Natural antisense mRNAs to hyaluronan synthase 2 inhibit hyaluronan biosynthesis and cell proliferation," J. Biol. Chem. 280(30):27513-27522 (2005).
Chapman et al., "Therapeutic antibody fragments with prolonged in vivo half-lives," Nature Biotech. 17:780-783 (1999).
Chen et al., "Mechanism-based tumor-targeting drug delivery system. Validation of efficient vitamin receptor-mediated endocytosis and drug release," Biconjug. Chem., 21:979-987 (2010).
Chenevert et al., "Monitoring early response of experimental brain tumors to therapy using diffusion magnetic resonance imaging," Clin Cancer Res. 3(9):1457-1466 (1997).
Cheng et al., "PEGylated adenoviruses for gene delivery to the intestinal epithelium by the oral route," Pharm. Res. 20(9):1444-1451 (2003).
Cherr et al., "The dual functions of GPI-anchored PH-20: hyaluronidase and intracellular signaling," Matrix Biol., 20(8):515-525 (2001).

(56) References Cited

OTHER PUBLICATIONS

Chou et al., "Stereospecific synthesis of 2-Deoxy-2,2-difluororibonolactone and its use in the preparation of 2'-Deoxy-2',2'-difluoro-β-D-ribofuranosyl Pyrimidine Nucleosides: The key role of selective crystallization," Synthesis, (6):565-570 (1992).
Cirstoiu-Hapca et al., "Benefit of anti-HER2-coated paclitaxel-loaded immuno-nanoparticles in the treatment of disseminated ovarian cancer: Therapeutic efficacy and biodistribution in mice," J. Control Release, 144:324-331 (2010).
Civalleri et al., "Effects of adjuvant hyaluronidase in tumors refractory to chemotherapy. Review of the literature and pharmacokinetics of cisplatin after regional administration in animals and humans." G Chir 18(4):175-81 (1997) [article in Italian with English abstract].
Clinical Trials.gov, "Assessment of stromal response to nab-paclitaxel in combination with gemcitabine in pancreatic cancer," ClinicalTrials.gov identifier: NCT01442974, Published on Jun. 13, 2011 [online][retrieved on May 23, 2013] Retrieved from:<URL:clinicaltrials.gov/ct2/show/NCT01442974?term=01442974&rank=1, 5 pages.
ClinicalTrials.gov, "Safety study of PEGPH20 given to patients with advanced solid tumors," ClinicalTrials.gov identifier: NCT00834704; study first received: Jan. 29, 2009; last updated: Sep. 10, 2012. [retrieved on Feb. 15, 2013] Retrieved from the Internet<URL:clinicaltrials.gov/ct2/show/NCT00834704?term=PEGPH20&rank=1, 3 pages.
ClinicalTrials.gov, "Study of Gemcitabine + PEGPH20 vs Gemcitabine Alone in Stage IV Previously Untreated Pancreatic Cancer," ClinicalTrials.gov identifier: NCT01453153; study first received: Oct. 13, 2011; last updated: Oct. 17, 2012. [retrieved on Feb. 15, 2013] Retrieved from the Internet:<URL:clinicaltrials.gov/ct2/show?term=PEGPH20&rank=3, 3 pages.
ClinicalTrials.gov, "Study of PEGPH20 with initial dexamethasone premedication given intravenously to patients with advanced solid tumors," Clinical Trials.gov identifier: NCT01170897; study first received: Jul. 26, 2010; last updated: Sep. 21, 2012. [retrieved on Feb. 14, 2013] Retrieved from the Internet:< URL:clinicaltrials.gov/ct2/show/NCT01170897?term=HALO-102&rank=1, 3 pages.
Cortes, J and R. Pazdur, "Docetaxel," J. Clin. Oncol. 13(10):2643-2655 (1995).
Curry et al., "Crystal structure of human serum albumin complexed with fatty acid reveals an asymmetric distribution of binding sites," Nat. Struct. Biol., 5: 827-835 (1998).
Damen et al., "Paclitaxel esters of malic acid as prodrugs with improved water solubility," Bioorg. Med. Chem. Lett., 8:427-432 (2000).
Danilkovitch-Miagkova et al., "Hyaluronidase 2 negatively regulates RON receptor tyrosine kinase and mediates transformation of epithelial cells by jaagsiekte sheep retrovirus," Proc Natl Acad Sci US A. 100(8):4580-4585 (2003).
Das et al., "Novel taxoid-based tumor-targeting drug conjugates," Chim Oggi. 27(6):54-56 (2009).
Davies et al., "Radiation improves the distribution and uptake of liposomal doxorubicin (caelyx) in human osteosarcoma xenograph," Cancer Research, 64:547-553 (2004).
De Maeyer et al., "The growth rate of two transplantable murine tumors, 3LL lung carcinoma and B16F10 melanoma, is influenced by Hyal-1, a locus determining hyaluronidase levels and polymorphism," Int. J. Cancer 51:657-660 (1992).
DeBoer et al., "The tac promoter: a functional hybrid derived from the trp and lac promoters," Proc. Natl. Acad. Sci. USA 80:21-25 (1983).
Delpech et al., "Enzyme-linked hyaluronectin: a unique reagent for hyaluronan assay and tissue location and for hyaluronidase activity detection," Anal. Biochem. 229:35-41 (1995).
Derwent Abstract for International Publication No. WO 1988002261. Inventor: Baumgartne et al., published Apr. 7, 1988, entitled "Treatment of brain tumours—with hyaluronidase." WPI Acc No. 1988-105412/198815, 2 pages.

Derwent English abstract for Japanese Publication No. JP 2006-265117, published Oct. 15, 2006, entitled "Leflunomide useful for activating inhibition of Akt signaling pathway, suppressing cell growth, inducing apoptosis in cancer cells, and as pharmaceuticals for preventing and treating cancer, e.g. breast cancer." WPI Acc No. 2006-0735114, 1 page.
Derwent English abstract for Japanese Publication No. JP 2006-298892, published Nov. 2, 2006, entitled "Pharmaceutical composition useful for treating cancer e.g. brain tumor and stomach cancer, comprises combination of hyaluronic acid synthesis inhibiting factor and antitumor substance." WPI Acc. No. 2007-003740, 1 page.
Desai et al., "Improved effectiveness of nanoparticle albumin-bound (nab) paclitaxel versus polysorbate-based docetaxel in multiple xenografts as a function of HER2 and SPARC status," Anti-cancer Drugs 19(9):899-909 (2008).
Desai et al., "SPARC expression correlates with tumor response to albumin-bound paclitaxel in head and neck cancer patients," Transl Oncol. 2(2):59-64 (2009).
Deutch et al., "Synthesis of congeners and prodrugs. 3. Water-soluble prodrugs of taxol with potent antitumor activity," J. Med. Chem., 32:788-792 (1989).
Di Stefano et al., "Inhibition of [3H]thymidine incorporation into DNA of rat regenerating liver by 2',2'-difluorodeoxycytidine coupled to lactosaminated poly-L-lysine," Biochem. Pharmacol., 57:793-799 (1999).
Edward et al., "4-Methylumbelliferone inhibits tumour cell growth and the activation of stromal hyaluronan synthesis by melanoma cell-derived factors," Br. J. Dermatol. 162(6):1224-1232 (2010).
Egberts et al. "Dexamethasone reduces tumor recurrence and metastasis after pancreatic tumor resection in SCID mice," Cancer Biol Ther 7(7):1044-1050 (2008).
Eikenes et al., "Hyaluronidase induces a transcapillary pressure gradient and improves the distribution and uptake of liposomal doxorubicin (Caelyx) in human osteosarcoma xenografts," British Journal of Cancer 93:81-88 (2005).
Eisenhaber et al., "Prediction of potential GPI-modification sites in proprotein sequences," J. Mol. Biol. 292(3):741-758 (1999).
Eliopoulos et al., "Drug resistance to 5-aza-2'-deoxycytidine, 2',2'-difluorodeoxycytidine, and cytosine arabinoside conferred by retroviral-mediated transfer of human cytidine deaminase cDNA into murine cells," Cancer Chemother. Pharmacol. 42:373-378 (1998).
Ernst et al., "Enzymatic degradation of glycosaminoglycans," Critical Reviews in Biochemistry and Molecular Biology 30(5):387-444 (1995).
Fadnes et al., "Interstitial fluid pressure in rats measured with a modified wick technique," Microvasc. Res. 14(1):27-36 (1977).
Fankhauser, N. and P.Mäser, "Identification of GPI anchor attachment signals by a Kohonen self-organizing map," Bioinformatics 21(9) 1846-1852 (2005).
Fehske et al., "The location of drug binding sites in human serum albumin," Biochem. Pharmcol., 30:687-692 (1981).
Felix et al., "Pegylated peptides. IV. Enhanced biological activity of site-directed pegylated GRF analogs," Int. J. Peptide Res. 46:253-264 (1995).
Foote, M., "Using nanotechnology to improve the characteristics of antineoplastic drugs: improved characteristics of nab-paclitaxel compared with solvent-based paclitaxel," Biotechnology Annual Review, 13:345-357 (2007).
Fossa et al., "Weekly docetaxel and prednisolone versus prednisolon alone in androgen-independent prostate cancer: A randomized phase II study," European Urology 52(6):1691-1699 (2007).
Frese et al., "Nab-Paclitaxel potentiates gemcitabine activity by reducing cytidine deaminase levels in a mouse model of pancreatic cancer," Cancer Discovery, 2:260-269 (2012).
Frost et al., "Purification, cloning, and expression of human plasma hyaluronidase," Biochem. Biophys. Res. Commun. 236(1):10-15 (1997).
Frost, G. and R. Stern, "A microtiter-based assay for hyaluronidase activity not requiring specialized reagents," Anal. Biochem. 251:263-269 (1997).

(56) References Cited

OTHER PUBLICATIONS

Frost, G., "Recombinant human hyaluronidase (rHuPH20): an enabling platform for subcutaneous drug and fluid administration," Expert Opin. Drug. Deliv. 4:427-440 (2007).

Fu et al., "Medicinal chemistry of paclitaxel and its analogues," Current Medicinal Chemistry, 16:1-13 (2009).

Gabizon et al., "Pharmacokinetics of pegylated liposomal Doxorubicin: review of animal and human studies," Clin Pharmacokinet 42:419-436 (2003).

Garber, K., "Stromal depetion goes on trial in pancreatic cancer." J Natl Cancer Inst. 102(7):448-50 (2010).

Gardner et al.,"The complete nucleotide sequence of an infectious clone of cauliflower mosaic virus by M13mp7 shotgun sequencing." Nucleic Acids Res. 9:2871-2888 (1981).

Garrido et al.,"[Characterization of propofol binding to plasma proteins and possible interactions]." Rev. Esp. Anestestiol. Reanim., 41:308-312 (1994) [English Abstract only, Article in Spanish].

Gemzar highlights of prescribing information, Eli Lilly and Company [online][retrieved on May 30, 2013] Retrieved from:<URL:pi.lilly.com/us/gemzar.pdf>, 18 pages.

Gilbert, W. and L. Villa-Komaroff, "Useful proteins from recombinant bacteria," Scientific American 242(4):74-94 (1980).

Gomez Paloma et al., "Conformation of a water-soluble derivative of taxol in water by 2D-NMR spectroscopy," Chem. Biol., 1:107-112 (1994).

Greenwald et al., "Drug delivery systems: water soluble taxol 2'-poly(ethylene glycol) ester prodrugs-design and in vivo effectiveness," J. Med. Chem., 39:424-431 (1996).

Greenwald et al.,"Highly water soluble taxol derivatives: 7-polyethylene glycol carbamates and carbonates," J. Org. Chem., 60:331-336 (1995).

Gribskov et al., "Sigma factors from E. coli, B. subtilis, phage SP01, and phage T4 are homologous proteins," Nucl. Acids Res. 14(16):6745-6763 (1986).

Grosschedl et al., "Introduction of a mu immunoglobulin gene into the mouse germ line: specific expression in lymphoid cells and synthesis of functional antibody," Cell 38:647-658 (1984).

Grothaus et al., "Taxane-specific monoclonal antibodies: measurement of taxol, baccatin III, and "total taxanes" in Taxus brevifolia extracts by enzyme immunoassay," J Nat. Prod., 58:1003-1014 (1995).

Guillemard, V. and H. Saragovi, "Taxane-antibody conjugates afford potent cytotoxicity, enhanced solubility, and tumor target selectivity," Cancer Res., 61:694-699 (2001).

Guo et al.,"Selective protection of 2',2'-difluorodeoxycytidine (Gemcitabine)," J. Org. Chem., 64:8319-8322 (1999).

Guo et al.,"Targeted delivery of a peripheral benzodiazepine receptor ligand-gemcitabine conjugate to brain tumors in a xenograft model," Cancer Chemother. Pharmacol.,48:169-176 (2001).

Haller et al., "Escaping the interstitial matrix with enzyme-mediated drug delivery," Drug Delivery Technology, 5(5):1-6 (2005).

Halozyme Therapeutics Clinical Trial Informed Consent Form, "A Phase 1, multicenter, open-label, dose escalation, safety, tolerability, pharmacokinetic and pharmacodynamic study of PEGPH20 (PEGylated recombinant human hyaluronidase) with intitial dexamethasone premedication given intravenously to patients with advanced solid tumors." Signed Jul. 16, 2010, 13 pages.

Halozyme Therapeutics, "Hylenex(R) recombinant (hyaluronidase human injection) and infiltration and extravasation," [online][retrieved on Apr. 3, 2013] Retrieved from:<URL:hylenex.com/files/resources_docs/Infiltration-Extravasation/documentation/Hylenex%20recombinant%20and%20Infiltration-Extravasation.pdf, 7 pages.

Halozyme, Inc. Information and Consent Form, "A phase 2, randomized, multicenter study of PEGPH20 (PEGylated Recombinant Human Hyaluronidase) combined with nab-Paclitaxel plus gemcitabine compared with nab-Paclitaxel plus gemcitabine in subjects with stage IV previously untreated pancreatic Cancer," Study # HALO-109-202, Approved Feb. 14, 2013, 1 page.

Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).

Hammer et al., "Diversity of alpha-fetoprotein gene expression in mice is generated by a combination of separate enhancer elements," Science 235:53-58 (1987).

Hanahan, D., "Heritable formation of pancreatic beta-cell tumours in transgenic mice expressing recombinant insulin/simian virus 40 oncogenes," Nature 315(6015):115-122 (1985).

Hanna et al., "Synthesis of some 6-substituted 5-azacytidines," Collect. Czech. Chem. Commun., 63:222-230 (1998).

Harris, J. and R. Chess, "Effect of pegylation on pharmaceuticals," Nat Rev Drug Discov 2(3):214-221 (2003).

He et al.,"Atomic structure and chemistry of human serum albumin," Nature, 358, 209-215 (1992).

Heldin, C., "High interstitial fluid pressure—an obstacle in cancer therapy," Nat Rev Cancer, 4(10):806-813 (2004).

Heldin, P., "Importance of hyaluronan biosynthesis and degradation in cell differentiation and tumor formation," Brazilian J. Med. Biol. Res. 36:967-973 (2003).

Herrera-Estrella et al., "Light-inducible and chloroplast-associated expression of a chimaeric gene introduced into Nicotiana tabacum using a Ti plasmid vector," Nature 310(5973):115-120 (1984).

Hibi et al., "Chondroitinase C activity of Streptococcus intermedius," FEMS-Microbiol-Lett. 48(2):121-124 (1989).

Hidaka et al.,"Relationship between the structures of taxane derivatives and their microtubule polymerization activity," Biosci. Biotechnol. Biochem., 76:349-352 (2012).

Holton et al.,"First total synthesis of taxol. 2. Completion of the C and D rings," J. Am. Chem. Soc., 116:1597-1598 (1994).

Hong et al.,"Efficacy and tissue distribution of DHP107, an oral paclitaxel formulation," Mol. Cancer. Ther., 6: 3239-3247 (2007).

Hovingh, P. and A. Linker, "Hyaluronidase activity in leeches (Hirudinea)," Comp Biochem Physiol B Biochem Mol Biol. 124(3):319-326 (1999).

Itano, N. and K. Kimata, Altered hyaluronan biosynthesis in cancer progression. Seminars in cancer biology 18:268-274 (2008).

Itano et al., "Abnormal accumulation of hyaluronan matrix diminishes contact inhibition of cell growth and promotes cell migration," Proc. Natl. Acad. Sci. U.S.A. 99(6):3609-3614 (2002).

IUPAC-IUB Commission on Biochemical Nomenclature, "A one-letter notation for amino acid sequences: tentative rules," J. Biol. Chem. 243:3557-3559 (1968).

IUPAC-IUB, "Abbreviated nomenclature of synthetic poypeptides-polymerized amino acids-revised recommendations," Commission on Biochemical Nomenclature, Biochemistry 11:1726-1731 (1972).

Jacobetz et al., "Hyaluronan impairs vascular function and drug delivery in a mouse model of pancreatic cancer," Gut. 62(1):112-120 (2013).

Jay et al., "Construction of a general vector for efficient expression of mammalian proteins in bacteria: use of a synthetic ribosome binding site," Proc. Natl. Acad. Sci. USA 78:5543-5548 (1981).

Juttermann et al., "Toxicity of 5-aza-2'-deoxycytidine to mammalian cells is mediated primarily by covalent trapping of DNA methyltransferase rather than DNA demethylation," Proc. Natl. Acad. Sci. USA 91:11797-11801 (1994).

Kaiser, J, "Enzyme 'melts' cancer drug barrier," Published Mar. 2011 [online][retrieved on May 23, 2013] Retrieved from:<URL:news.sciencemag.org/sciencenow/2012/03/enzyme-melts-cancer-drug-barrier.html [2 pages].

Karvinen et al., "Hyaluronan, CD44 and versican in epidermal keratinocyte tumors," British Journal of Dermatology 148:86-94 (2003).

Kees et al.,"Development of resistance to 1-beta-D-arabinofuranosylcytosine after high-dose treatment in childhood lymphoblastic leukemia: analysis of resistance mechanism in established cell lines," Cancer Res. 49:3015-3019 (1989).

Kelsey et al., "Species- and tissue-specific expression of human alpha 1-antitrypsin in transgenic mice," Genes and Devel. 1:161-171 (1987).

Kendall, P., "The use of hydrocortisone by local injection," Ann Phys Med. 3(1):1-8 (1956).

(56) References Cited

OTHER PUBLICATIONS

Kimata et al., "Increased synthesis of hyaluronic acid by mouse mammary carcinoma cell variants with high metastatic potential," Cancer Res. 43: 1347-1354 (1983).
Kollias et al., "Regulated expression of human A gamma-, beta-, and hybrid gamma beta-globin genes in transgenic mice: manipulation of the developmental expression patterns," Cell 46:89-94 (1986).
Koyama et al., "Hyperproduction of hyaluronan in neu-induced mammary tumor accelerates angiogenesis through stromal cell recruitment: possible involvement of versican/PG-M," Am J Pathol. 170(3):1086-1099 (2007).
Kozak et al., "The effect of recombinant human hyaluronidase on dexamethasone penetration into the posterior segment of the eye after sub-tenon's injection," Journal of Ocular Pharmacology and Therapeutics, 22 (5): 362-369 (2006).
Kragh-Hansen, U., "Structure and ligand binding properties of human serum albumin," Dan. Med. Bull., 37:57-84 (1990).
Krumlauf et al., Developmental regulation of alpha-fetoprotein genes in transgenic mice, Mol. Cell. Biol. 5:1639-1648 (1985).
Krupers et al., "Complexation of poly(ethylene oxide) with poly(acrylic acid-co-hydroxyethyl methacrylate)s," Eur. Polym J. 32:785-790 (1996).
Kultti et al., "Therapeutic targeting of hyaluronan in the tumor stroma," Cancers. 4(3):873-903 (2012).
Kuznetsova et al., "Syntheses and evaluation of novel fatty acid-second-generation taxoid conjugates as promising anticancer agents," Bioorg. Med. Chem. Lett., 15:974-977 (2006).
Lalancette et al, "Characterization of an 80-kilodalton bull sperm protein identified as PH-20," Biol Reprod. 65(2):628-636 (2001).
Leder et al., "Consequences of widespread deregulation of the c-myc gene in transgenic mice: multiple neoplasms and normal development," Cell 45:485-495 (1986).
Leu et al.,"Characterization of polyclonal and monoclonal anti-taxol antibodies and measurement of taxol in serum," Cancer Res., 53:1388-1391 (1993).
Li et al.,"Complete regression of well-established tumors using a novel water-soluble poly(L-glutamic acid)-paclitaxel conjugate," Cancer Res., 58:2404-2409 (1998).
Li et al.,"In vitro and in vivo evaluation of folate receptor-targeting amphiphilic copolymer-modified liposomes loaded with docetaxel," International Journal of Nanomedicine, 6:1167-1184 (2011).
Li et al.,"Prodrugs of nucleoside analogues for improved oral absorption and tissue targeting," Journal Pharm. Science, 97:1109-1134 (2008).
Lipponen et al., "High stromal hyaluronan level is associated with poor differentiation and metastasis in prostate cancer," European Journal of Cancer 37:849-856 (2001).
Liu et al., "Controlled release of paclitaxel from a self-assembling peptide hydrogel formed in situ and antitumor study in vitro," Int J Nanomedicine. 6:2143-2153 (2011).
Lokeshwar et al., "Antitumor activity of hyaluronic acid synthesis inhibitor 4-methylumbelliferone in prostate cancer cells," Cancer Res 70(7):2613-2623 (2010).
Lokeshwar et al., "Tumor-associated hyaluronic acid: a new sensitive and specific urine marker for bladder cancer," Cancer Res. 57(4):773-777 (1997).
Lokeshwar et al., "Urinary hyaluronic acid and hyaluronidase: markers for bladder cancer detection and evaluation of grade," J. Urol. 163(1):348-356 (2000).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides. II. Solid-phase synthesis of amino-, carboxy- and side-chain pegylated peptides," Int. J. Peptide Protein Res. 43:127-138 (1994).
MacDonald, R., "Expression of the pancreatic elastase I gene in transgenic mice," Hepatology 7:42S-51S (1987).
Magram et al., "Developmental regulation of a cloned adult beta-globin gene in transgenic mice," Nature 315:338-340 (1985).

Mason et al., "The hypogonadal mouse: reproductive functions restored by gene therapy," Science 234:1372-1378 (1986).
Matousek et al., "Effect of hyaluronidase and PEG chain conjugation on the biologic and antitumor activity of RNase A," J Control Release 94(2-3):401-410 (2004).
Matthew et al.,"Synthesis and evaluation of some water-soluble prodrugs and derivatives of taxol with antitumor activity," J. Med. Chem., 35:145-151 (1992).
Mehvar et al., "Modulation of the pharmacokinetics and pharmacodynamics of proteins by polyethylene glycol conjugation," J. Pharm. Pharmaceut. Sci. 3(1):125-136 (2000).
Menzel, E. and C. Farr, "Hyaluronidase and its substrate hyaluronan: biochemistry, biological activities and therapeutic uses," Cancer Lett., 131:3-11 (2003).
Michelacci, Y. and C. Dietrich, "Chondroitinase C from Flavobacterium heparinum," J. Biol. Chem. 251:1154-1158 (1976).
Mita et al., "Phase 1 study of ATI-1123, a novel human serum albumin-stabilized nanoparticle Docetaxel liposomal formulation, in patients with advanced solid malignancies," [online][retrieved on May 23, 2013] Retrieved from:<URL:azayatherapeutics.com/files/AACR%20Molecular%20Targets_Clini_1.pdf, 1 page.
Molineux, G., "Pegylation: engineering improved biopharmaceuticals for oncology," Pharmacotherapy 23 (8 Pt 2):3S-8S (2003).
Momparler, R. and J. Laliberte, "Induction of cytidine deaminase in HL-60 myeloid leukemic cells by 5-aza-2'-deoxycytidine," Leuk. Res.14:751-754 (1990).
Momparler, R., "Molecular, cellular and animal pharmacology of 5-aza-2'-deoxycytidine," Pharmacol Ther 30:287-299 (1985).
Monfardini et al, "A branched monomethoxypoly(ethylene glycol) for protein modification," Bioconjugate Chem. 6:62-69 (1995).
Morgan et al.,"Activation-induced cytidine deaminase deaminates 5-methylcytosine in DNA and is expressed in pluripotent tissues: implications for epigenetic reprogramming," J. Biol. Chem., 279:52353-52360 (2004).
Morohashi et al., "Study of hyaluronan synthase inhibitor, 4-methylumbelliferone derivatives on human pancreatic cancer cell (KP1-NL)," Biochem Biophys Res Commun. 345(4):1454-1459.
Nakazawa et al., "4-methylumbelliferone, a hyaluronan synthase suppressor, enhances the anticancer activity of gemcitabine in human pancreatic cancer cells," Cancer Chemother Pharmacol 57(2):165-170 (2006).
Needleman, S. and C. Wunsch "A general method applicable to the search for similarities in the amino acid sequence of two proteins," J Mol Biol. 48:443-453 (1970).
Neuhaus et al.,"CONKO-001: final results of the randomized, prospective, multicenter phase III trial of adjuvant chemotherapy with gemcitabine versus observation in patients with resected pancreatic cancer (PC)," J Clin Oncol. 26(suppl LBA4504) (2008).
Nicolaou et al., "Total synthesis of taxol," Nature, 367:630-634 (1994).
Nicolaou et al., "Design, synthesis and biological activity of protaxols," Nature 364: 464-466 (1993).
Nicolaou et al., "A water-soluble prodrug of taxol with self-assembling properties," Angew Chemie International Edition in English, 33:1583-1587 (1994) [English edition equivalent of Nicolaou et al., "Ein wasserlösliches Prodrug von Taxol mit der Fhigkeit zur Selbstorganisation." Angew Chemie, 106:1672-1675 (1994)].
Nishida et al., "Antisense inhibition of hyaluronan synthase-2 in human articular chondrocytes inhibits proteoglycan retention and matrix assembly," J. Biol. Chem. 274(31):21893-21899 (1999).
Ochi et al., "Leflunomide-induced polymyositis in a patient with rheumatoid arthritis," 19(4):443-446 (2009).
Ohya, T., and Y. Kaneko, "Novel hyaluronidase from streptomyces," Biochim. Biophys. Acta 198:607-609 (1970).
Ojima et al.,"Tumor-specific novel taxoid-monoclonal antibody conjugates," J. Med. Chem., 45:5620-5623 (2002).
Olive et al.,"Inhibition of Hedgehog signaling enhances delivery of chemotherapy in a mouse model of pancreatic cancer," Science, 324:1457-1461 (2009).

(56) References Cited

OTHER PUBLICATIONS

Omaetxebarria et al., "Computational approach for identification and characterization of GPI-anchored peptides in proteomics experiments," Proteomics 7(12):1951-1960 (2007).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Ozerdem, U. and A. Hargens, "A simple method for measuring interstitial fluid pressure in cancer tissues," Microvasc. Res. 70:116-120 (2005).
Ozzello et al., "Growth-promoting activity of acid mucopolysaccharides on a strain of human mammary carcinoma cells," Cancer Res. 20:600-604 (1960).
Paal et al.,"High affinity binding of paclitaxel to human serum albumin," Eur. J. Biochem., 268:2187-2191 (2001).
Pawlowski et al., "The effects of hyalurodinase upon tumor formation in BALB/c mice painted with 7,12-dimethylbenz-(a)anthracene," Int. J. Cancer 23:105-109 (1979).
Pearson, W. and D. Lipman "Improved tools for biological sequence comparison," Proc. Natl. Acad. Sci. USA 85:2444-2448 (1988).
Pham et al., "Large-scale transient transfection of serum-free suspension-growing HEK293 EBNA1 cells: peptone additives improve cell growth and transfection efficiency," Biotechnology and Bioengineering 84:332-342 (2003).
Pierleoni et al., "PredGPI: a GPI-anchor predictor," BMC Bioinformatics 9:392, 11 pages (2008).
Pillwein et al., "Hyaluronidase additional to standard chemotherapy improves outcome for children with malignant brain tumors," Cancer Lett 131:101-108 (1998).
Pinkert et al., "An albumin enhancer located 10 kb upstream functions along with its promoter to direct efficient, liver-specific expression in transgenic mice," Genes and Devel. 1:268-276 (1987).
Pirinen et al., "Prognostic value of hyaluronan expression in non-small-cell lung cancer: Increased stromal expression indicates unfavorable outcome in patients with adenocarcinoma," Int J Cancer 95(1):12-17 (2001).
Piskala, A. and F. Sorm, "Direct synthesis of a 5-azapyrimidine ribonucleoside by the tri-methylsilyl procedure," Nucl. Acid. Chem., 1:435-441 (1978).
Piskala et al., "Direct synthesis of 5-azapyrimidine 2'-deoxyribonucleosides. Hydrolysis of 5-aza-2'-deoxycytidine," Nucleic Acids Research 1 (suppl. 1):s109-s114 (1978).
Pliml, J. and F. Šorm, "Synthesis of a deoxy-D-ribofuranosyl-5-cytosine," Collect. Czech. Chem. Commun. 29:2576-2578 (1964).
Provenzano et al., "Enzymatic targeting of the stroma ablates physical barriers to treatment of pancreatic ductal adenocarcinoma," Cancer Cell. 21(3):418-429 (2012).
Purcell et al., "Interaction of taxol with human serum albumin," Biochim. Biophys. Acta, 1478(1):61-68 (2000).
Readhead et al., "Expression of a myelin basic protein gene in transgenic shiverer mice: correction of the dysmyelinating phenotype," Cell 48:703-712 (1987).
Richardson et al.,"Synthesis and restriction enzyme analysis of oligodeoxyribonucleotides containing the anti-cancer drug 2',2'-difluoro-2'-deoxycytidine," Nucleic Acid Res., 20:1763-1768 (1992).
Roberts et al., "Chemistry for peptide and protein PEGylation," Advanced Drug Delivery Review 54:459-476 (2002).
Ropponen et al., "Tumor cell-associated hyaluronan as an unfavorable prognostic factor in colorectal cancer," Cancer Research 58:342-347 (1998).
Rosenthal et al., "Phase I and pharmacokinetic evaluation of intravenous hyaluronic acid in combination with doxorubicin or 5-fluorouracil," Chemotherapy 51:132-141 (2005).
Sadeghi et al., "Effect of hydrophilic components of the extracellular matrix on quantifiable diffusion-weighted imaging of human gliomas: preliminary results of correlating apparent diffusion coefficient values and hyaluronan expression level," AJR Am J Roentgenol. 181(1):235-241 (2003).
Safavy et al.,"Paclitaxel derivatives for targeted therapy of cancer: toward the development of smart taxanes," J. Med. Chem., 42:4919-4924 (1999).
Safavy et al.,"Synthesis and biological evaluation of paclitaxel-C225 conjugate as a model for targeted drug delivery," Bioconjug., 14:302-310 (2003).
Sahoo et al.,"Efficacy of transferrin-conjugated paclitaxel-loaded nanoparticles in a murine model of prostate cancer," Int. J. Cancer, 112:335-340 (2004).
Sampath et al.,"Mechanisms of apoptosis induction by nucleoside analogs," Oncogene, 22:9063-9074 (2003).
Sato et al., "Cloning and expression in *Escherichia coli* of the gene encoding the Proteus vulgaris chondroitin ABC lyase," Appl. Microbiol. Biotechnol. 41(1):39-46 (1994).
Sato, H., "Enzymatic procedure for site-specific pegylation of proteins," Adv. Drug Deilv. Rev. 54:487-504 (2002).
Sawhney et al., "Bioerodible hydrogels based on photopolymerized poly(ethylene glycol)-co poly(hydroxyl acid) Diacrylate Macromers," Macromolecules 26:581-587 (1993).
Schwartz, R. and M. Dayhoff, "Matrices for Detecting Distance Relationships," *Atlas of Protein Sequence and Structure*, National Biomedical Research Foundation, pp. 353-358 (1979).
Shani, M., "Tissue-specific expression of rat myosin light-chain," Nature 314:283-286 (1985).
Sheikh et al., "Continuous-flow fluoro-immunosensor for paclitaxel measurement," Biosensors & Bioelectronics, 16:647-652 (2001).
Simpson et al., "Inhibition of prostate tumor cell hyaluronan synthesis impairs subcutaneous growth and vascularization in immunocompromised mice," Am J Pathol 161(3):849-857 (2002).
Simpson et al., "Manipulation of hyaluronan synthase expression in prostate adenocarcinoma cells alters pericellular matrix retention and adhesion to bone marrow endothelial cells," J. Biol. Chem. 277(12):10050-10057 (2002).
Singh et al., "Efficacy of hydrocortisone acetate/hyaluronidase vs triamcinolone acetonide/hyaluronidase in the treatment of oral submucous fibrosis," Indian J Med Res. 131:665-669 (2010).
Smith et al., "Hyaluronidase enhances the therapeutic effect of vinblastine in intralesional treatment of Kaposi's sarcoma," J. Am. Acad Dermatol 36:239-242 (1997).
Smith, T. and M. Waterman, "Comparison of biosequences," Advances in Applied Mathematics 2:482-489 (1981).
St Croix et al., "Reversal of intrinsic and acquired forms of drug resistance by hyaluronidase treatment of solid tumors," Cancer Lett 131(1):35-44 (1998).
Stem, R., "Devising a pathway for hyaluronan catabolism: are we there yet?" Glycobiology 13:105R-115R (2003).
Stuhlmeier, K., "Effects of leflunomide on hyaluronan synthases (HAS): NF-kappa B-independent suppression of IL-1-induced HAS1 transcription by leflunomide," J Immunol 174(11):7376-7382 (2005).
Sugio et al.,"Crystal structure of human serum albumin at 2.5 A resolution," Protein. Eng., 12, 439-446 (1999).
Suye et al.,"A receptor protein-based bioassay for quantitative determination of paclitaxel," Anal. Chem., 69:3633-3635 (1997).
Svojanovsky et al.,"High sensitivity ELISA determination of taxol in various human biological fluids," Journal of Pharmaceutical and Biomedical Analysis, 20:549-555 (1999).
Swift et al., "Tissue-specific expression of the rat pancreatic elastase I gene in transgenic mice," Cell 38(3):639-646 (1984).
Takahashi et al., "A fluorimetric Morgan-Elson assay method for hyaluronidase activity," Anal. Biochem. 322:257-263 (2003).
Tammi et al., "Hyaluronan in human tumors: pathobiological and prognostic messages from cell-associated and stromal hyaluronan," Seminar in Cancer Biology 18:288-395 (2008).
Tkalec et al., "Isolation and expression in *Escherichia coli* of cslA and cslB, genes coding for the chondroitin sulfate-degrading enzymes chondroitinase AC and chondroitinase B, respectively, from Flavobacterium heparinum," Applied and Environmental Microbiology 66(1):29-35 (2000).

(56) References Cited

OTHER PUBLICATIONS

Tomiak et al. "Phase I study of docetaxel administered as a 1-hour intravenous infusion on a weekly basis," J Clin Oncol. 12(7):1458-1467 (1994).
Toole et al., "Hyaluronan-cell interactions in cancer and vascular disease," J Biol Chem. Feb. 15, 2002;277(7):4593-4596. Epub Nov. 20, 2001.
Trédan et al., "Drug resistance and the solid tumor microenvironment," J. Natl. Cancer Inst. 99(19):1441-1454 (2007).
Tsubery et al., "Prolonging the action of protein and peptide drugs by a novel approach of reversible polyethylene glycol modification," J Biol. Chem 279(37):38118-38124 (2004).
Tsuda et al., "Substrate specificity studies of flavobacterium chondroitinase C and heparitinases towards the glycosaminoglycan—protein linkage region. Use of a sensitive analytical method developed by chromophore-labeling of linkage glycoserines using dimethylaminoazobenzenesulfonyl chloride," Eur. J. Biochem. 262:127-133 (1999).
Tyle, P., "Iontophoretic devices for drug delivery," Pharmaceutical Research 3(6):318-326 (1986).
Udabage L., "Antisense-mediated suppression of hyaluronan synthase 2 inhibits the tumorigenesis and progression of breast cancer," Cancer Res. 65(14):6139-6150 (2005).
Udenfriend, S. and K. Kodukula, "Prediction of omega site in nascent precursor of glycosylphosphatidylinositol protein," Methods Enzymol. 250:571-582 (1995).
Ueda et al.,"Novel water soluble phosphate prodrugs of taxol® possessing in vivo antitumor activity," Bioorg. Med. Chem. Lett., 3:1761-1766 (1993).
Urien et al.,"Docetaxel serum protein binding with high affinity to alpha 1-acid glycoprotein," Invest. New Drugs, 14(2), 147-151 (1996).
USP XXII-NF XVII, United States Pharmacopeia Convention, Inc, Rockville, MD., pp. 644-645 (1990).
Vaage et al., "Tissue distribution and therapeutic effect of intravenous free or encapsulated liposomal doxorubicin on human prostate carcinoma xenografts," Cancer 73:1478-1484 (1994).
Veronese et al., "Branched and linear poly(Ethylene Glycol): influence of the polymer structure on enzymological, pharmacokinetic, and immunological properties of protein conjugates," J. Bioactive Compatible Polymers 12:196-207 (1997).
Vishnu et al., "Safety and efficacy of nab-Paclitaxel in the treatment of patients with breast cancer," Breast Cancer: Basic and Clinical Research 5:53-65 (2011).
Von Hoff et al.,"Gemcitabine plus nab-paclitaxel is an active regimen in patients with advanced pancreatic cancer: a phase I/II trial," J. Clin. Oncol., 29:4548-4554 (2011).
Vorbrueggen et al.,"Nucleoside syntheses, XXII1) Nucleoside synthesis with trimethylsilyl triflate and perchlorate as catalysts," Chemische Berichte, 114:1234-1255 (1981).
Vorum, H., "Reversible ligand binding to human serum albumin. Theoretical and clinical aspects," Dan. Med. Bull., 46:379-399 (1999).
Voytek et al.,"Comparative studies of the cytostatic action and metabolism of 5-azacytidine and 5,6-dihydro-5-azacytidine," Cancer Res., 37:1956-1961 (1977).
Vyas et al., "Synthesis and antitumor evaluation of water soluble taxol phosphates," Bioorg. Med. Chem., Lett., 3:1357-1360 (1993).
Wagner et al., "Nucleotide sequence of the thymidine kinase gene of herpes simplex virus type 1," Proc. Natl. Acad. Sci. USA 78:1441-1445 (1981).
Wani et al., "Plant antitumor agents. VI. The isolation and structure of taxol, a novel antileukemic and antitumor agent from Taxus brevifolia," J. Am. Chem. Soc., 93:2325-2327 (1971).
Watson et al., *Molecular Biology of the Gene*, 4th Edition, The Benjamin/Cummings Pub. Co., p. 224 (1987).
Wen et al., "GRN1005 phase I studies: Final results." in Proceedings of the AACR-NCI-EORTC International Conference: Molecular Targets and Cancer Therapeutics; Mol Cancer Ther 10(11 Suppl):Abstract B49 (2011).

Wentworth, D. and R. Wolfenden "Cytidine deaminases (from *Escherichia coli* and human liver," Methods Enzymol. 57:401-407 (1978).
Whatcott et al., "Targeting the tumor microenvironment in cancer: why hyaluronidase deserves a second look," Cancer Discov. 1(4):291-296 (2011).
Winkley et al.,"Direct glycosylation of 1,3,5-triazinones. A new approach to the synthesis of the nucleoside antibiotic 5-azacytidine (4-amino-1-beta-D-ribofuranosyl-1,3,5-triazin-2-one) and related derivatives," J Org Chem, 35:491-495 (1970).
Wisdom, G. and B. Orsi, "Cytidine aminohydrolase from sheep liver," Biochem. J. 104:7P (1967).
Yamada et al.,"Biological evaluation of paclitaxel-peptide conjugates as a model for MMP2-targeted drug delivery," Cancer Biology and Therapy, 9:192-203 (2010).
Yamagata et al., "Purification and properties of bacterial chondroitinases and chondrosulfatases," J. Biol. Chem. 243: 1523-1535 (1968).
Yamamoto et al., "Identification of a functional promoter in the long terminal repeat of Rous sarcoma virus," Cell 22:787-797 (1980).
Yang et al., "Purification and characterization of heparinase from Flavobacterium heparinum," J. Biol. Chem. 160(30):1849-1857 (1985).
Yoshihara et al., "A hyaluronan synthase suppressor, 4-methylumbelliferone, inhibits liver metastasis of melanoma cells," FEBS Lett 579(12):2722-2726 (2005).
Zalipsky, S., "Chemistry of polyethylene glycol conjugates with biologically active molecules," Adv. Drug Del. Rev. 16:157-182 (1995).
Zanker et al., "Induction of response in previous chemotherapy resistant patients by hyaluronidase," Proc. Amer. Assoc. Cancer Res. 27:390 Abstract 1550 (1986).
Zhao, Z. and D. Kingston, "Modified taxols, 6. Preparation of water-soluble prodrugs of Taxol," J. Nat. Prod., 54:1607-1611 (1991).
Zhao et al.,"RGD-based strategies for improving antitumor activity of paclitaxel-loaded liposomes in nude mice xenografted with human ovarian cancer," J. Drug Target, 17:10-18 (2009).
Zhao, X. and J. Harris, "Novel degradable poly(ethylene glycol) esters for delivery," in Poly(ethylene glycol), Chemistry and Biological Applications, ACS Symposium Series 680, Hams, J. and S. Zalipsky, (eds), 458-472 (1997).
Borad et al., "Targeting hyaluronan (HA) in tumor stroma: a phase I study to evaluate the safety, pharmacokinetics (PK), and pharmacodynamics (PD) of pegylated hyaluronidase (PEGPH20) in Patients with solid tumors," 2012 ASCO Annual Meeting, Jun. 1-5, 2012 Chicago, IL. Abstract 2579. [Published on-line May 16, 2012], 3 pages.
Borad et al., "Targeting Hyaluronan (HA) in Tumor Stroma: A Phase I Study to Evaluate the Safety, Pharmacokinetics (PK), and Pharmacodynamics (PD) of Pegylated Hyaluronidase (PEGPH20) in Patients with Solid Tumors" 2012 ASCO Annual Meeting, Jun. 1-5, 2012 Chicago, IL. Poster 2579, 1 page.
Dychter et al., "Targeting hyaluronan in tumor stroma. Interim translational and biomarker evaluations of pegylated hyaluronidase (PEGPH20) in animal models and patients with advanced solid tumors," European Organisation for Research and Treatment of Cancer—National Cancer Institute—American Society of Clinical Oncology (EORTC-NCI-ASCO) Annual Meeting on "Molecular Markers in Cancer", Oct. 27-29, 2011, Brussels, Belgium. European Journal of Cancer 47(Suppl.4):S30-S31, pp. 60, abstract, 2 pages.
Haberman et al., Proceedings of the 17th Annual Meeting of the American Society of Clinical Oncology, Washington, D.C., 22:105, abstract No. 415 (1981).
Halozyme Therapeutics, "Matrix therapies for life," Presented at Canaccord Cardiovascular, Diabetes & Obesity Conference, Dec. 8, 2010. Presentation, 38 pages.
Halozyme Therapeutics, J.P. Morgan Annual Healthcare Conference Presentation, Jan. 2013, Presentation, 18 pages.

(56) References Cited

OTHER PUBLICATIONS

Harris et al., "Pharmacokinetic (PK)/pharmacodynamic (PD) results from a phase Ib study of pegylated hyaluronidase PH20 (PEGPH20) in combination with gemcitabine (Gem) in patients with pancreatic cancer," 2013 ASCO Annual Meeting, J Clin Oncol 31, 2013 (suppl; abstr e15005) Available online May 15, 2013, 3 pages.

Hingorani et al., "A phase Ib study of gemcitabine plus PEGPH20 (pegylated recombinant human hyaluronidase) in patients with stage IV previously untreated pancreatic cancer," 2013 ASCO Annual Meeting, J Clin Oncol 31, 2013 (suppl; abstr 4010) Epub date May 15, 2013, 3 pages.

Hingorani et al., "A phase Ib study of gemcitabine plus PEGPH20 (pegylated recombinant human hyaluronidase) in patients with stage IV previously untreated pancreatic cancer," 2013 ASCO Annual Meeting, Chicago, IL, Poster #4010, 1 page.

Infante et al., "Targeting hyaluronan (HA) in tumor (T) stroma. Interim safety and translational evaluation of pegylated hyaluronidase (PEGPH20, P) in patients (PTS) with advanced solid tumors—a focus on GI malignancies," 2012 Gastrointestinal Cancers Symposium, Jan. 19-21, 2012, San Francisco, CA. Abstract No. 249, available on-line Jan. 1, 2012, 3 pages.

Jiang et al "PEGPH20: PEGylated recombinant human hyaluronidase antitumor activity in the 4T1 orthotopic breast carcinoma model," 2009 AACR Apr. 9, 2009, Abstract, 1 page.

Jiang et al "PEGPH20: PEGylated recombinant human hyaluronidase antitumor activity in the 4T1 orthotopic breast carcinoma model," 2009 AACR Apr. 9, 2009, Poster, 1 page.

Jiang et al., "Effects of recombinant human PH20 (rHuPH20) on interstitial matrices: creating a favorable environment for the delivery of cytostatic agents," [abstract]. In: Proceedings of the 96th Annual Meeting of the American Association for Cancer Research; Apr. 16-20, 2005; Anaheim, CA.:AACR; 2005. vol. 46, p. 1198, Abstract No. 5075, XP001525054, Apr. 2005.

Jiang et al., "Phase 1 pharmacodyamic activity of multiple-dose PEGylated hyaluronidase PH20 (PEGPH20) in patients with solid tumors," AACR Annual Meeting Apr. 6-10, 2013, Washington, D.C., Abstract 3375, [Retrieved from the Internet Apr. 5, 2013], 1 page.

Jiang et al., "Phase 1 pharmacodyamic activity of multiple-dose PEGylated hyaluronidase PH20 (PEGPH20) in patients with solid tumors," AACR Annual Meeting 2013 Apr. 6-10, 2013, Washington, D.C., Poster 3375, 1 page.

Kadhim et al., "Antitumor activity of pegylated recombinant human hyaluronidase (PEGPH20) in xenograft and syngeneic Rat MatLyLu prostate carcinoma models," AACR Meeting, Apr. 19, 2009, Denver, CO., Poster #260, 1 page.

Kadhim et al., "PEGPH20: PEGylated Human Recombinant PH20 Hyaluronidase Shows Significant Antitumor Activity Concomitant with Hyaluronan Reduction in the PC3 Hormone Refractory Prostate Cancer Model" AACR 2009. Poster #8569, 1 page.

Kadhim et al., "Antitumor activity of pegylated recombinant human hyaluronidase (PEGPH20) in xenograft and syngeneic Rat MatLyLu prostate carcinoma models," AACR Meeting Apr. 9, 2009 Abstract # 260, [accessed on-line Apr. 3, 2009], 2 pages.

Kadhim et al., "Synergistic anti-tumor effects of pegylated recombinant human hyaluronidase (PEGPH20) with Gemcitabine in subcutaneous pancreatic cancer xenograft models." AACR 101st Annual Meeting, Washington D.C., Apr. 21, 2010. Abstract #5392, 1 page.

Kadhim et al., "Synergistic anti-tumor effect of pegylated recombinant human hyaluronidase (PEGrHuPH20) with cytotoxic agents following intravenous administration in a hormone refractory prostate cancer xenograft model," American Association for Cancer Research (AACR) Translational Cancer Medicine Meeting, Monterey, CA, Jul. 21, 2008, Abstract #A45, 1 page.

Kadhim et al., "Synergistic anti-tumor effect of pegylated recombinant human hyaluronidase (PEGrHuPH20) with cytotoxic agents following intravenous administration in a hormone refractory prostate cancer xenograft model," American Association for Cancer Research (AACR) Translational Cancer Medicine Meeting, Monterey, CA, Jul. 21, 2008. Poster #A45, 1 page.

Li et al, "PEGylated human recombinant hyaluronidase (PEGPH20) removes peritumoral hyaluronan and increases the efficacy of chemotherapy and radiotherapy in an experimental brain metastisis model," ASCR, Apr. 9, 2009. Abstract #262, 2 pages.

Li et al, "PEGylated human recombinant hyaluronidase (PEGPH20) removes peritumoral hyaluronan and increases the efficacy of chemotherapy and radiotherapy in an experimental brain metastisis model," ASCR, Apr. 9, 2009. Poster #262, 1 page.

Maneval et al., "Phase 1 pharmacokinetics (PK) & pharmacodynamics (PD) of PEGylated hyaluronidase PH20 (PEGPH20) in patients with solid tumors," AACR Annual Meeting 2012. Available on-line Mar. 2012. [Retrieved from the internet Apr. 17, 2012], Abstract #2672, 1 page.

Osgood et al., "Pegylated recombinant human hyaluronidase PH20 (PEGPH20) enhances Nab-Paclitaxel efficacy in BxPC-3 human pancreatic cancer xenografts," AACR Annual Meeting 2012, Abstract #5635, Available on-line Mar. 2012. [Retrieved from the internet Mar. 26, 2012], 1 page.

Osgood et al., "Pegylated recombinant human hyaluronidase PH20 (PEGPH20) enhances Nab-Paclitaxel efficacy in BxPC-3 human pancreatic cancer xenografts," AACR Annual Meeting 2012. Chicago, IL, Presented Apr. 4, 2012. Poster #5635, 1 page.

Osgood et al., "Pegylated recombinant human hyaluronidase PH20 (PEGPH20) enhances Nab-Paclitaxel efficacy in BxPC-3 human pancreatic cancer xenografts," Cancer Research 72(8):Suppl 1, 2 pages (2012).

Ramanathan et al., "Targeting hyaluronan in tumor stroma: Interim translational & biomarker evaluations of pegylated hyaluronidase (PEGPH20) in animal models & patients with advanced solid tumors," European Organisation for Research and Treatment of Cancer-National Cancer Institute-American Society of Clinical Oncology (EORTC-NCI-ASCO) Annual Meeting on "Molecular Markers in Cancer", Oct. 27-29, 2011, Brussels, Belgium. Poster, 1 page.

Shepard et al., "Targeting hyaluronan (HA) in the tumor stroma. Translational evaluation of pegylated hyaluronidase (PEGPH20) in animal models and patients with advanced solid tumors" EORTC-ASCO-NCI meeting Hollywood Florida on Oct. 19, 2010, Poster, 1 page.

Shepard et al.,"Hyaluronan: The glue that holds a tumor together," Biotherapeutic Targets, Boston, MA, May 21, 2010. Oral presentation, 26 pages.

Shepard, M., "PEGPH20—A targeted therapy for cancer treatment," presented at Target Discovery World Congress, South San Francisco, CA. on Aug. 4-5 2009. Oral presentation, 13 pages.

Singha et al., "Hyaluronan-rich ECM contributes to resistance to antibody-dependent cell-mediated cytotoxicity in solid tumors," AACR Annual Meeting 2013 Apr. 6-10, 2013, Washington, D.C., Abstract #4999 [Retrieved from the internet Apr. 5, 2013], 1 page.

Singha et al., "Hyaluronan-rich ECM contributes to resistance to antibody-dependent cell-mediated cytotoxicity in solid tumors," AACR Annual Meeting 2013, Apr. 6-10, 2013, Washington, D.C., Poster #4999, 1 page.

Singha et al., "PEGPH20 depletion of pericellular hyaluronan sensitizes high hyaluronan-producing tumor cells in antibody-dependent cell-mediated cytotoxicity," presented at AACR Special Conferenece: Molecularly Targeted Therapies: Mechanisms of Resistance. May 9-12, 2012, San Diego, CA. Abstract, 1 page.

Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting 2008, San Diego, CA. Abstract, 1 page.

Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, Apr. 12-16, 2008, San Diego, CA. Poster, 1 page.

(56) References Cited

OTHER PUBLICATIONS

Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Abstract #4955 [Retrieved from the internet Apr. 5, 2013], 1 page.

Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Poster #4955, 1 page.

Thompson et al., "Pegylated recombinant human hyaluronidase PH20 (PEGPH20) reduces 18FDG-PET uptake in mouse xenografts and phase 1 cancer patients," Society of Nuclear Medicine and Molecular Imaging (SNMMI) 2013 Mid-Winter Meeting, Jan. 23-27, 2013, New Orleans, LA. Abstract, 1 page.

Thompson et al., "Pegylated recombinant human hyaluronidase PH20 (PEGPH20) reduces 18FDG-PET uptake in mouse xenografts and phase 1 cancer patients," Society of Nuclear Medicine and Molecular Imaging (SNMMI) 2013 Mid-Winter Meeting, Jan. 23-27, 2013, New Orleans, LA. Poster #73, 1 page.

Whatcott et al., "Hyaluronan deposition correlates with poor survival in pancreatic cancer" American Association of Cancer Research Annual Meeting, Orlando, FL. Apr. 5, 2011. Abstract, 1 page.

Halozyme Therapeutics Investor Presentation, "Halozyme Therapeutics, Inc.: Thinking outside the cell," Presented on Oct. 2, 2012 [online][retrieved on Oct. 11, 2012] Retrieved from:<URL:sec.gov/Archives/edgar/data/1159036/000119312512412748/d419091dex991.htm [82 pages].

News release, "Halozyme studies target hyaluronan surrounding solid tumors, May offer new approach to cancer treatment," Published on Apr. 20, 2009 [online][retrieved on Jun. 23, 2009], Retrieved from:<URL:aim168realestate.com/real-estate-news/united-states-of-america/20155/halozyme [4 pages].

News Release, "Halozyme's pegylated enzyme found to be effective in preclinical studies," Published on-line Jul. 24, 2008 at http://inwardinvestment.pharmaceutical-business-review.com/news/a849fhalozymes_pegylated_enzyme_found_to_be_effective_in_preclinical_st [accessed Jun. 12, 2013], 2 pages.

News Release, "Halozyme's phase 1b clinical trial of PEGPH20 with Gemcitabine indicates positive activity against pancreatic cancer," Published on-line Jun. 3, 2013 and Retrieved from:<URL:firstwordpharma.com/node/1098370?tsid=4 (accessed Jun. 12, 2013)>, 3 pages.

News Release, Halozyme Therapeutics Inc. "Halozyme Therapeutics' CEO discusses Q4 2012 results—earnings call transcript," Published on Feb. 25, 2013 [online][retrieved on Jun. 12, 2013] Retrieved from :<URL:seekingalpha.com/article/1222991-halozyme-therapeutics-ceo-discusses-q4-2012-results-earnings-call-transcript?part=single>, 16 pages.

News Release, Halozyme Therapeutics, Inc., "Halozyme therapeutics, inc. begins phase 1 clinical study with PEGPH20 in cancer patients with refractory solid tumors," Published on Mar. 31, 2009[online][retrieved on Apr. 27, 2010] Retrieved from:<URL:in.reuters.com/money/quotes/keyDevelopments?symbol=HALO.O, 2 pages.

News Release, Halozyme Therapeutics, Inc., "Halozyme Therapeutics announces data from two phase 1 studies of PEGPH20 demonstrating targeting of hyaluronan in tumor stroma," Published on Oct. 27, 2011[online][retrieved on Nov. 17, 2011] Retrieved from:<URL: halozyme.com/Investors/News-Releases/News-Release-Details/2011/Halozyme-Therapeutics-Announces-Data-From-Two-Phase-1-Studies-of-PEGPH20-Demonstrating-Targeting-of-Hyaluronan-in-Tumor-Strom/default.aspx>, 3 pages.

Transcript, "Halozyme Therapeutics's CEO hosts analyst/investor day conference call (Transcript),"Published on Oct. 2, 2012 [online] [Retrieved on Oct. 25, 2012] Retrieved from the Internet: URL:seekingalpha.com/article/901141-halozyme-therapeutics-s-ceo-hosts-analyst-investor-day-conference-call-transcript?part=single, 49 page.

News Release, "Halozyme Therapeutics to Present at the 31st Annual J.P. Morgan Healthcare Conference," Published Jan. 3, 2013 [online][Retrieved Jan. 17, 2013][Retrieved from the Internet: URL:halozyme.com/Investors/News-Releases/News-Release-Details/2013/Halozyme-Therapeutics-to-Present-at-the-31st-Annual-JP-Morgan-Healthcare-Conference1132508/default.aspx], 2 pages.

News Release, "Halozyme begins randomized, controlled clinical trial with PEGPH20 in patients with advanced pancreatic cancer," Published Oct. 5, 2011 [online][Retrieved May 30, 2013][URL:halozyme.com/Investors/News-Releases/News-Release-Details/2011/Halozyme-Begins-Randomized-Controlled-Clinical-Trial-with-PEGPH20-in-Patients-with-Advanced-Pancreatic-Cancer1126802/default.aspx], 3 pages.

News Release, "Halozyme initiates randomized phase 2 trial of PEGPH20 in pancreatic cancer," Published Apr. 23, 2013 [online][Retrieved May 16, 2013][Retrieved from:<URL:halozyme.com/Investors/News-Releases/News-Release-Details/2013/Halozyme-Initiates-Randomized-Phase-2-Trial-of-PEGPH20-in-Pancreatic-Cancer/default.aspx>, 3 pages.

News Release, "Halozyme to Present New Data on PEGPH20 in Pancreatic Cancer aAt American Society of Clinical Oncology Annual Meeting," Published May 15, 2013 [online][Retrieved May 16, 2013][Retrieved from:<URL:halozyme.com/Investors/News-Releases/News-Release-Details/2013/Halozyme-To-Present-New-Data-On-PEGPH20-In-Pancreatic-Cancer-At-American-Society-of-Clinical-Oncology-Annual-Meeting/default.aspx>, 3 pages.

International Search Report and Written Opinion, dated Jul. 2, 2013, in connection with International Patent Application No. PCT/US2013/032684, 18 pages.

Letter/Written Disclosure of the Supplemental Information Disclosure Statement for the above-referenced application, dated Jul. 2, 2014, 2 pages.

Danhier et al., "To exploit the tumor microenvironment: Passive and active tumor targeting of nanocarriers for anti-cancer drug delivery," J Control Release. 148(2):135-146 (2010).

Paiva et al., "Expression patterns of hyaluronan, hyaluronan synthases and hyaluronidases indicate a role for hyaluronan in the progression of endometrial cancer," Gynecol Oncol. 98(2):193-202 (2005).

Pritzker, K., "Cancer biomarkers: easier said than done," Clin Chem. 48(8):1147-1150 (2002).

Tahara et al., "Intracellular drug delivery using polysorbate 80-modified poly(D,L-lactide-co-glycolide) nanospheres to glioblastoma cells," J Microencapsul. 28(1):29-36 (2011).

TAXOTERE 80 mg/2 ml-Konzetrat and Losungsmittel zur Herstellung einer Infusionslosung, Feb. 2012 [in German], 2 pages.

Certified English translation of TAXOTERE 80 mg/2 ml-Konzetrat and Losungsmittel zur Herstellung einer Infusionslosung, Feb. 2012, 6 pages.

Frost, G., "Halozyme Therapeutics, Inc. Thinking outside the cell," Oct. 2013. Presentation, 46 pages.

News release, Halozyme Therapeutics, Inc., "Halozyme announces temporary halt of phase 2 trial enrollment and dosing for PEGPH20," Published on Apr. 4, 2014 [online][retrieved on Apr. 14, 2014] Retrieved from:<URL:halozyme.com/Investors/News-Releases/News-Release-Details/2014/Halozyme-Announces-Temporary-Halt-Of-Phase-2-Trial-Enrollment-And-Dosing-For-PEGPH20/default.aspx [2 pages].

News release, Halozyme Therapeutics, Inc., "Halozyme announces clinical hold of PEGPH20 pancreatic cancer trial following voluntary halt of trial by Halozyme," Published on Apr. 9, 2014 [online][retrieved on Apr. 14, 2014] Retrieved from:<URL:halozyme.com/Investors/News-Releases/News-Release-Details/2014/Halozyme-Announces-Clinical-Hold-of-PEGPH20-Pancreatic-Cancer-Trial-Following-Voluntary-Halt-of-Trial-by-Halozyme/default.aspx [2 pages].

News release, Halozyme Therapeutics, Inc., "Halozyme announces preclinical data presentations at the Association of Cancer Research Annual Meeting," Published on Apr. 8, 2014 [online][retrieved on Apr. 14, 2014] Retrieved from:<URL:halozyme.com/Investors/News-Releases/News-Release- Details/2014/Halozyme-Announces-Preclinical-Data-Presentations-At-The-Association-Of-Cancer-Research-Annual-Meeting/default.aspx [3 pages].

(56) References Cited

OTHER PUBLICATIONS

News Release, "Halozyme to resume PEGPH20 clinical program in pancreatic cancer," Published Jun. 4, 2014 [online][Retrieved Jun. 6, 2014] Retrieved from the internet: <URL:halozyme.com/Investors/News-Releases/News-Release-Details/2014/Halozyme-To-Resume-PEGPH20-Clinical-Program-In-Pancreatic-Cancer/default.aspx, 2 pages.
Response, dated Feb. 4, 2014, to Written Opinion, Jul. 2, 2013, in connection with International Patent Application No. PCT/US2013/032684, 49 pages.
Second Written Opinion, dated Apr. 10, 2014, in connection with International Patent Application No. PCT/US2013/032684, 14 pages.
Response, dated Jun. 10, 2014, to second Written Opinion, dated Apr. 10, 2014, in connection with International Patent Application No. PCT/US2013/032684, 39 pages.
Letter/Written Disclosure of the Supplemental Information Disclosure Statement for the above-referenced application, filed herewith Aug. 19, 2015, 2 pages.
Bouzin, C. and O. Feron, "Targeting tumor stroma and exploiting mature tumor vasculature to improve anti-cancer drug delivery," Drug Resistance Updates 10(3):109-120 (2007).
Chirgwin, J. and S. Chua, "Management of breast cancer with nanoparticle albumin-bound (nab)-paclitaxel combination regimens: A clinical review," The Breast, 20(5):394-406 (2011).
Fu et al., "Medicinal chemistry of paclitaxel and its analogues," Current Medicinal Chemistry, 16(30):3966-3985 (2009).
Greenway, S., "The Next Chapter Begins: Creating Value Through Growth," Presented at the JMP Securities 2015 Life Sciences Conference, Jun. 24, 2015, 24 pages.
Miele et al., "Albumin-bound formulation of paclitaxel (Abraxane® ABI-007) in the treatment of breast cancer," International Journal of Nanomedicine 4:99-105 (2009).
"PEGPH20: The Science & The Strategy," presented at J. P. Morgan Healthcare Conference on Jan. 7, 2015. Presentation. 81 pages.
Piccart, M., "nab™-Paclitaxel: A targeted chemotherapy to improve outcomes in metastatic breast cancer," Asia-Pacific Journal of Oncology and Hematology 1:5-12 (2009).
Singha et al., "Hyaluronan (HA) depletion sensitizes HA(high) tumors to antibody-dependent cell-mediated cytotoxicity," presented at San Antonio Breast Cancer Symposium (SABCS), Dec. 9-13, 2014. San Antonio, TX. Abstract P5-04-02, 1 page.
Singha et al., "Hyaluronan (HA) depletion sensitizes HA(high) tumors to antibody-dependent cell-mediated cytotoxicity," presented at San Antonio Breast Cancer Symposium (SABCS), Dec. 9-13, 2014. San Antonio, TX. Poster P5-04-02, 6 pages.
Sparreboom et al., "Paclitaxel repackaged in an Albumin-Stabilized Nanoparticle: Handy or just a dandy?" Journal of Clinical Oncology 23(31):7765-7767 (2005).
Torley, H., "UBS Global Health Care Conference," Presented at theUBS Global Health Care Conference May 18, 2015, 21 pages.
Torley, H., "Halozyme Therapeutics, Inc. The next chapter begins: creating value through growth," Presented at the 32nd Annual J.P. Morgan Healthcare Conference Jan. 2014, 26 pages.
Whatcott et al., "Abstract 191: Desmoplasia in primary tumors and metastatic lesions of pancreatic cancer," Cancer Res 74; 191 (2014) [Proceedings: AACR Annual Meeting 2014; Apr. 5-9, 2014; San Diego, CA].
Zhao et al, "Hyaluronan-dependent growth of human triple negative breast cancer MDA-MB-468 in mouse xenograft models," presented at AACR Annual Meeting, Apr. 20, 2015. Philadelphia, PA. Abstract 2392, 2 pages.
Zhao et al, "Hyaluronan-dependent growth of human triple negative breast cancer MDA-MB-468 in mouse xenograft models," presented at AACR Annual Meeting, Apr. 20, 2015. Philadelphia, PA. Poster, 6 pages [Corresponding to Abstract 2392].
News Release, Halozyme Therapeutics, Inc., "Halozyme Therapeutics provides an update on anticipated milestones for 2015 at the 33rd Annual J. P. Morgan Healthcare Conference," Published Jan. 12, 2015 [online], Retrieved from: <URL: halozyme.com/Investors/News-Releases/News-Release-Details/2015/Halozyme-Therapeutics-Provides-An-Update-On-Anticipated-Milestones-For-2015-At-The-33rd-Annual-J-P-Morgan-Healthcare-Conference/default.aspx [retrieved on Jan. 14, 2015], 3 pages.
News Release, Halozyme Therapeutics, Inc., "Halozyme Reports Fourth Quarter and Full Year 2014 Financial Results," Published Mar. 2, 2015 [online], Retrieved from: <URL: halozyme.com/Investors/News-Releases/News-Release-Details/2015/Halozyme-Reports-Fourth-Quarter-And-Full-Year-2014-Financial-Results/default.aspx [retrieved on Mar. 9, 2015], 7 pages.
News Release, Halozyme Therapeutics, Inc., "Halozyme Therapeutics provides update following Type B FDA Meeting," Published Apr. 8, 2015 [online], Retrieved from: <URL: halozyme.com/Investors/News-Releases/News-Release-Details/2015/Halozyme-Provides-Update-Following-Type-B-FDA-Meeting/default.aspx [retrieved on Apr. 8, 2015], 3 pages.
News Release, Halozyme Therapeutics, Inc., "Eisai and Halozyme sign collaboration agreement to investigate Eribulin and PEGPH20 in metastatic breast cancer," Published Jul. 31, 2015 [online], Retrieved from: <URL:halozyme.com/Investors/News-Releases/News-Release-Details/2015/Eisai-and-Halozyme-Sign-Collaboration-Agreement-to-Investigate-Eribulin-and-PEGPH20-in-Metastatic-Breast-Cancer/default.aspx [retrieved on Aug. 11, 2015], 4 pages.
News Release, Halozyme Therapeutics, Inc., "UCSF to study Halozyme PEGPH20 in pancreatic cancer patients who are candidates for potentially curative surgery," Published Aug. 6, 2015 [online], Retrieved from: <URL:halozyme.com/Investors/News-Releases/News-Release-Details/2015/UCSF-To-Study-Halozyme-PEGPH20-In-Pancreatic-Cancer-Patients-Who-Are-Candidates-For-Potentially-Curative-Surgery/default.aspx [retrieved on Aug. 11, 2015], 3 pages.
Response, filed Aug. 12, 2015, to Communication pursuant to Rules 161(1) and 162, dated Feb. 20, 2015, in connection with European Patent Application No. 13715069.4, 40 pages.
Search Report and Written Opinion, dated Jun. 17, 2015, in connection with Singaporean Patent Application No. 11201406340Q, 28 pages.
Notice of Formality Acceptance, dated Apr. 13, 2015, in connection with corresponding Vietnamese Application No. 1-2014-03210 [English language translation and original document in Chinese], 2 pages.
Letter/Written Disclosure of the Supplemental Information Disclosure Statement for the above-referenced application, filed herewith Sep. 25, 2015, 3 pages.
Office Action, dated Aug. 19, 2015, in connection with Korean Patent Application No. 10-2014-7030904 [English translation and original document in Korean], 12 pages.
Examination Report, dated Aug. 24, 2015, in connection with New Zealand Patent Application No. 700073, 2 pages.
Letter/Written Disclosure of the Supplemental Information Disclosure Statement for the above-referenced application, filed herewith Apr. 6, 2106, 2 pages.
Blast search results for SEQ ID No. 1 [search date Jun. 19, 2015], 3 pages.
Blast search results for SEQ ID No. 4 [search date Jun. 19, 2015], 4 pages.
Buey et al., "Microtubule interactions with chemically diverse stabilizing agents: thermodynamics of binding to the paclitaxel site predicts cytotoxicity," Chemistry and Biology 12:1269-1279 (2005).
Vanhoefer et al., "Comparative antitumor efficacy of docetaxel and paclitaxel in nude mice bearing human tumor xenografts that overexpress the multidrug resistance protein (MRP)," Annals of Oncology 8:1221-1228 (1997).
Winefield et al., "Differences in paclitaxel and docetaxel interactions with tubulin detected by mutagenesis of yeast tubulin," ChemMedChem 3(12): 1844-1847 (2008).
Belani, B., "PEGPH20: Update on investigation in lung cancer," Presented at Targeted Therapies of Lung Cancer Meeting Feb. 17-20, 2016, 7 pages.

(56) References Cited

OTHER PUBLICATIONS

Clift et al., "PEGylated recombinant hyaluronidase PH20 (PEGPH20) enhances pemetrexed antitumor efficacy in a human nonsquamous NSCLC xenograft model," for presentation at AACR Annual Meeting, Apr. 17, 2016. New Orleans, LA. Abstract #283, 1 page.

Cowell et al., "PEGPH20 increases the anticancer activity of standard chemotherapy combinations, vincristine (VIN) and D actinomycin (DACT), in a Wilms' xenograft model," for presentation at AACR Annual Meeting, Apr. 18, 2016. New Orleans, LA. Abstract #2463, 1 page.

Mazzola, J. "Platforms for Growth: Corporate Overview," Presented Dec. 8, 2015 at the Oppenheimer 26th Annual Helathcare Conference, 22 pages [presentation].

Torley, H., "Platforms for Growth: Building a Premier Oncology Biotech," Presented at the 34th Annual J.P. Morgan Healthcare Conference Jan. 2016, 26 pages.

News Release, Halozyme Therapeutics, Inc., "Halozyme Phase 2 Clinical Study of Investigational Drug PEGPH20 Shows Doubling of Progression-free Survival and Improvement Trend in Overall Survival in High HA Metastatic Pancreatic Cancer Patients," Published May 31, 2015 [online], Retrieved from: <URL:prnewswire.com/news-releases/halozyme-phase-2-clinical-study-of-investigational-drug-pegph20-shows-doubling-of-progression-free-survival-and-improvement-trend-in-overall-survival-in-high-ha-metastatic-pancreatic-cancer-patients-300091301.html [retrieved on Jun. 2, 2015], 4 pages.

News Release, Halozyme Therapeutics, Inc., "Halozyme Provides Key Program Updates, 2016 Financial Guidance at 34th Annual JP Morgan Healthcare Conference," Published Jan. 11, 2016 [online], Retrieved from: <URL: prnewswire.com/news-releases/halozyme-provides-key-program-updates-2016-financial-guidance-at-34th-annual-jp-morgan-healthcare-conference-300202007.html [retrieved on Jan. 14, 2016], 5 pages.

News Release, Halozyme Therapeutics, Inc., "Halozyme Doses First Patient in Phase 3 Clinical Trial of PEGPH20 in Combination With ABRAXANE® and Gemcitabine," Published Mar. 16, 2016 [online], Retrieved from: <URL: halozyme.com/investors/news-releases/news-release-details/2016/Halozyme-Doses-First-Patient-In-Phase-3-Clinical-Trial-Of-PEGPH20-In-Combination-With-ABRAXANE-And-Gemcitabine/default.aspx [retrieved on Mar. 16, 2016], 5 pages.

News Release, Halozyme Therapeutics, Inc., "Halozyme to Present Data from Five Preclinical Studies at American Association of Cancer Research Annual Conference," Published Mar. 17, 2016 [online], Retrieved from: <halozyme.com/investors/news-releases/news-release-details/2016/Halozyme-To-Present-Data-From-Five-Preclinical-Studies-At-American-Association-Of-Cancer-Research-Annual-Conference/default.aspx [retrieved on Mar. 28, 2016], 3 pages.

Examination Report, dated Dec. 10, 2015, in connection with Australian Patent Application No. 2013243873, 3 pages.

Response, filed Nov. 20, 2015, to Examination Report, dated Sep. 10, 2015, in connection with Canadian Patent Application No. 2,869,460, 34 pages.

Examiner's Report, dated Dec. 22, 2015, in connection with Canadian Patent Application No. 2,869,460, 5 pages Response, filed Mar. 22, 2016, to Examiner's Report, dated Dec. 22, 2015, in connection with Canadian Patent Application No. 2,869,460, 31 pages.

Response, filed Jan. 25, 2016, to Office Action, dated Oct. 9, 2015, in connection with Chinese Patent Application No. 201380029337.9, 38 pages [English instructions and document as filed in Chinese].

Communication pursuant to Article 94(3), dated Feb. 1, 2016, issued in connection with European Patent Application No. 13715069.4, 7 pages.

Response, filed Feb. 15, 2016, to Official Action, dated Nov. 17, 2015, in connection with Japanese Patent Application No. 2015-504602 [English instructions and document as filed in Japanese], 34 pages.

Letter, dated Jul. 8, 2015, reporting Prior Art Search, issued by the Korean Institute of Patent Information on Jun. 19, 2015, in connection with Korean Patent Application No. 10-2014-7030904, 2 pages.

Response, filed Oct. 16, 2015, to Office Action, dated Aug. 19, 2015, in connection with Korean Patent Application No. 10-2014-7030904 [English instructions and document as filed in Korean], 75 pages.

Office Action, dated Dec. 14, 2015, in connection with Korean Patent Application No. 10-2014-7030904 [English translation and original document in Korean], 5 pages.

Response, filed Mar. 16, 2016, to Office Action, dated Dec. 14, 2015, in connection with Korean Patent Application No. 10-2014-7030904 [English instructions and document as filed in Korean], 43 pages.

Response, filed Oct. 6, 2015, to Examination Report, dated Aug. 24, 2015, in connection with New Zealand Patent Application No. 700073, 23 pages.

Response, filed Apr. 4, 2016, to Examination Report, dated Nov. 3, 2015, in connection with New Zealand Patent Application No. 700073, 35 pages.

Response, filed Nov. 17, 2015, to Search Report and Written Opinion, dated Jun. 10, 2015, in connection with Singaporean Patent Application No. 11201406340Q, 33 pages.

Notice of Eligibility for Grant, dated Jan. 14, 2016, in connection with Singaporean Patent Application No. 11201406340Q, 14 pages.

Letter/Written Disclosure of the Supplemental Information Disclosure Statement for the above-referenced application, filed herewith Dec. 11, 2015, 6 pages.

Desai et al., "Enhanced efficacy and safety of nanoparticle albumin-bound nab-docetaxel versus taxotere," Cancer Research 66:1277 (2006).

Gradishar et al., "Albumin-bound paclitaxel: a next generation taxane," Expert Opinion on Pharmacotherapy 7(8):1041-1053 (2006).

Gradishar, J., "Significantly longer progression free survival with nab-paclitaxel compared with docetaxel as first-line therapy for metastatic breast cancer," Journal of Clinical Oncology 27(22):3611-3619 (2009).

Osmond et al., "ABI-013: A novel nanoparticle albumin-bound (nab) docetaxel analog with superior antitumor activity over docetaxel," Cancer Research 70:4420 (2010).

Thompson et al., "Enzymatic depletion of tumor hyaluronan induces antitumor responses in preclinical animal models," Molecular Cancer Therapeutics 9(11):3052-3064 (2010).

Examination Report, dated Sep. 10, 2015, in connection with Canadian Patent Application No. 2,869,460, 7 pages.

Office Action, dated Oct. 9, 2015, in connection with Chinese Patent Application No. 201380029337.9 [English translation and original document in Chinese], 17 pages.

Examination Report, dated Nov. 3, 2015, in connection with New Zealand Patent Application No. 700073, 6 pages.

Official Action, dated Nov. 17, 2015, in connection with Japanese Patent Application No. 2015-504602 [English translation and original document in Japanese], 6 pages.

Letter/Written Disclosure of the Supplemental Information Disclosure Statement for the above-referenced application, filed herewith on Nov. 23, 2016, 6 pages.

Murphy et al., "Targeted nanogels: a versatile platform for drug delivery to tumors," Mol Canc Ther 10(6):972-982 (2011).

Examiner's Report, dated Oct. 26, 2016, in connection with Canadian Patent Application No. 2,869,460, 5 pages.

Communication pursuant to Article 94(3), dated Oct. 18, 2016, issued in connection with European Patent Application No. 13715069.4 [D1=WO 2009/128917; D2=WO 2011/057034; D4=Kadhim et al., "Synergistic anti-tumor effects of pegylated recombinant human hyaluronidase (PEGPH20) with Gemcitabine in subcutaneous pancreatic cancer xenograft models," AACR 101st Annual Meeting, Washington D.C., Apr. 21, 2010, Abstract #5392, 1 page.; D5=Frese et al.,"nab-Paclitaxel potentiates gemcitabine activity by reducing cytidine deaminase levels in a mouse model of pancreatic cancer," Cancer Discovery, 2:260-269 (2012).), 8 pages.

(56) References Cited

OTHER PUBLICATIONS

Decision to Grant, dated Oct. 25, 2016, in connection with Japanese Patent Application No. 2015-504602 [English letter reporting decision to grant and original document in Japanese], 4 pages.
Examination Report, dated Nov. 3, 2016, in connection with New Zealand Patent Application No. 723245, 6 pages.
Letter/Written Disclosure of the Supplemental Information Disclosure Statement for the above-referenced application, filed herewith on May 11, 2016, 6 pages.
Maitra et al., "Nab-paclitaxel targets tumor stroma and results, combined with gemcitabine, in high efficacy against pancreatic cancer models," Molecular Cancer Therapeutics, 8: C246. Presented Nov. 15-19, 2009 at the AACR-NCI-EORTC International Conference: Molecular Targets and Cancer Therapeutics, Boston, MA.
Decision of Grant, issued Apr. 5, 2016, in connection with Korean Patent Application No. 10-2014-7030904 [English translation and original document in Korean], 6 pages.
Official Action, dated Apr. 12, 2016, in connection with Japanese Patent Application No. 2015-504602 [English translation and original document in Japanese], 7 pages.
Examination Report, dated Apr. 27, 2016, in connection with New Zealand Patent Application No. 700073, 7 pages.
Notice of Preliminary Rejection, dated Apr. 5, 2016, in connection with Korean Patent Application No. 10-2016-7006716 [English translation and original document in Korean], 11 pages.
Letter/Written Disclosure of the Supplemental Information Disclosure Statement for the above-referenced application, filed herewith on Oct. 18, 2016, 2 pages.
Andreollo et al., "Rat's age versus human's age: What is the relationship?" ABCD Arq Bras Cir Dig 25(1):1-3 (2012).
Stelzer, L., "Platforms for Growth: Building a Premier Oncology Biotech," Presented at the UBS Global Health Care Conference on May 24, 2016, 25 pages.
News Release, Halozyme Therapeutics, Inc., "Halozyme Presents Stage One Efficacy and Safety Analysis of Phase 2 Clinical Study in Metastatic Pancreatic Cancer Patients Treated with PEGPH20," Published Jun. 4, 2016 [online], Retrieved from: <URL:halozyme.com/investors/news-releases/news-release-details/2016/Halozyme-Presents-Stage-One-Efficacy-And-Safety-Analysis-Of-Phase-2-Clinical-Study-In-Metastatic-Pancreatic-Cancer-Patients-Treated-With-PEGPH20/default.aspx [retrieved on Jun. 7, 2016], 6 pages.
News Release, Halozyme Therapeutics, Inc., "Halozyme Reports Second Quarter 2016 Financial Results," Published Aug. 9, 2016 [online], Retrieved from: <URL:prnewswire.com/news-releases/halozyme-reports-second-quarter-2016-financial-results-300311374.html [retrieved on Aug. 31, 2016], 10 pages.
Response, filed May 7, 2016, to Examination Report, dated Dec. 10, 2015, in connection with Australian Patent Application No. 2013243873, 36 pages.
Examination Report, dated May 24, 2016, in connection with Australian Patent Application No. 2013243873, 4 pages.
Response, filed Jul. 21, 2016, to Examination Report, dated May 24, 2016, in connection with Australian Patent Application No. 2013243873, 15 pages.
Notice of Acceptance, dated Aug. 16, 2016, in connection with Australian Patent Application No. 2013243873, 3 pages.
Examiner's Report, dated May 5, 2016, in connection with Canadian Patent Application No. 2,869,460, 5 pages.
Response, filed Aug. 5, 2016, to Examiner's Report, dated May 5, 2016, in connection with Canadian Patent Application No. 2,869,460, 31 pages.
Office Action, dated May 25, 2016, in connection with Chinese Patent Application No. 201380029337.9 [English translation and original document in Chinese], 11 pages.
Response, filed Sep. 14, 2016, to Office Action, dated May 25, 2016, in connection with Chinese Patent Application No. 201380029337.9 [English instructions and document as filed in Chinese], 30 pages.

Letter, dated Oct. 6, 2016, reporting Office Action, dated Sep. 5, 2016, in connection with Eurasian Patent Application No. 201401096 [English letter and original document in Russian], 3 pages.
Response, filed Jun. 2, 2016, to Communication pursuant to Article 94(3), dated Feb. 1, 2016, in connection with European Patent Application No. 13715069.4, 19 pages.
Response, filed Aug. 4, 2016, to Official Action, dated Apr. 12, 2016, in connection with Japanese Patent Application No. 2015-504602 [English instructions and document as filed in Japanese], 41 pages.
Response, filed Aug. 5, 2016, to Office Action, dated Apr. 5, 2016, in connection with Korean Patent Application No. 10-2016-7006716 [English instructions and document as filed in Korean], 78 pages.
Response, filed Aug. 13, 2016, to Examination Report, dated Apr. 27, 2016, in connection with New Zealand Patent Application No. 700073, 33 pages.
Notice of Acceptance, dated Aug. 18, 2016, in connection with New Zealand Patent Application No. 700073, 1 page.
Certificate of Grant, dated Apr. 7, 2016, in connection with Singaporean Patent Application No. 11201406340Q, 1 page.
Letter/Written Disclosure of the Supplemental Information Disclosure Statement for the above-referenced application, filed herewith Aug. 17, 2017, 6 pages.
Abraxane Prescribing Information. Revised Jul. 2015 [online] Retrieved from <URL:medsafe.govt.nz/profs/datasheet/a/abraxaneinj.pdf [accessed on Feb. 22, 2017], 24 pages.
Abraxane Oconologic Drugs Advisory Committee Meeting. Presented Sep. 7, 2006 [online] Retrieved from <URL:fda.gov/ohrms/dockets/ac/06/briefing/2006-4235B2-01-01AbraxisBioscience-background.pdf [accessed on Feb. 22, 2017], 56 pages.
Halozyme Therapeutics, Halozyme Investor Call "Study 202 Overall Results and Stage 2 Results," conducted Jan. 5, 2017, 32 pages.
Hingorani et al., "Randomized phase II study of PEGPH20 plus nabpaclitaxel/ gemcitabine (PAG) vs AG in patients (Pts) with untreated, metastatic pancreatic ductal adenocarcinoma (mPDA)," presented at 2017 American Society of Clinical Oncology (ASCO) Annual Meeting on Jun. 4, 2017, Chicago, IL, Abstract #4008, 2 pages.
Hingorani et al., "HALO-2002 Randomized phase II study of PEGPH20 plus nabpaclitaxel/gemcitabine (PAG) vs AG in patients (Pts) with untreated, metastatic pancreatic ductal adenocarcinoma (mPDA)," presented at 2017 American Society of Clinical Oncology (ASCO) Annual Meeting on Jun. 4, 2017, Chicago, IL [Presentation], 16 pages.
Ma et al., "Evaluating clinically relevant pharmacological agents in a rat ambulation model to ameliorate PEGylated recombinant hyaluronidase PH20 (PEGPH20)-mediated musculoskeletal adverse events," presented at American Association for Cancer Research (AACR) Annual Meeting on Apr. 3, 2017. Washington D.C.. Abstract #1240/25 [retrieved Mar. 17, 2017; available online Mar. 1, 2017], 2 pages.
Torley, H., "Building a Premier Oncology Biotech: Two Pillar Strategy for Growth," presented at 35th Annual J.P. Morgan Healthcare Conference on Jan. 9, 2017. San Francisco, CA. 27 pages.
Torley, H., "Building a Premier Oncology Biotech: Two Pillar Strategy for Growth," presented Sep. 2016; retrieved from <URL: halozyme.com/files/doc_presentations/2016/Halozyme-Overview-09-22-16_Website.pdf [retrieved on Jan. 17, 2017], 30 pages.
Zheng et al., "Global phase 3, randomized, double-blind, placebo-controlled study evaluating PEGylated recombinant human hyaluronidase PH20 (PEGPH20) plus nab-paclitaxel and gemcitabine in patients with previously untreated, hyaluronan (HA)-high, stage IV pancreatic ductal adenocarcinoma," presented at American Association for Cancer Research (AACR) Annual Meeting, Apr. 3, 2017 [retrieved on Apr. 4, 2017]. Washington D.C.. Abstract CT066, 2 pages.
FDA News Release, "FDA approves Abraxane for late-stage pancreatic cancer," Published on Sep. 6, 2013 [online] Retrieved from <URL:fda.gov/NewsEvents/Newsroom/PressAnnouncements/ucm367442.htm [retrieved on Feb. 22, 2017], 2 pages.

(56) References Cited

OTHER PUBLICATIONS

News Release, "Halozyme Announces Phase 2 Study in Advanced Pancreas Cancer Meets Key Endpoints," Published Jan. 5, 2017 [online] Retrieved from:<URL:halozyme.com/investors/news-releases/news-release-details/2017/Halozyme-Announces-Phase-2-Study-In-Advanced-Pancreas-Cancer-Meets-Key-Endpoints/default.aspx#sthash.e6ergCVY.dpuf [retrieved on Jan. 5, 2017], 4 pages.
News Release, "Halozyme Phase 2 Data in Advanced Pancreas Cancer to be Featured in an Oral Presentation at ASCO," Published May 17, 2017 [online] Retrieved from:<URL:prnewswire.com/news-releases/halozyme-phase-2-data-in-advanced-pancreas-cancer-to-be-featured-in-an-oral-presentation-at-asco-300459642.html [retrieved on May 19, 2017], 5 pages.
News Release, "Halozyme Phase 2 Data in Advanced Pancreas Cancer Featured in an Oral Presentation at ASCO," Published Jun. 4, 2017 [online] Retrieved from:<URL:prnewswire.com/news-releases/halozyme-phase-2-data-in-advanced-pancreas-cancer-featured-in-an-oral-presentation-at-asco-300468303.html [retrieved on Jun. 6, 2017], 5 pages.
News Release, "ASCO 2017: Adding PEGPH20 to Standard Treatment in Metastatic Pancreatic Cancer May Delay Disease Progression," Published Jun. 8, 2017 [online] Retrieved from:<URL: ascopost.com/News/55726 [retrieved on Jul. 21, 2017], 2 pages.
Response, dated Jan. 26, 2017, to Examiner's Report, dated Oct. 26, 2016, in connection with Canadian Patent Application No. 2,869,460, 31 pages.
Examiner's Report, dated Mar. 29, 2017, in connection with Canadian Patent Application No. 2,869,460, 6 pages.
Response, filed Jun. 29, 2017, to Examiner's Report, dated Mar. 29, 2017, in connection with Canadian Patent Application No. 2,869,460, 40 pages.
Examiner's Report, dated Jul. 14, 2017, in connection with Canadian Patent Application No. 2,869,460, 7 pages.
Office Action, dated Jan. 20, 2017, in connection with Chinese Patent Application No. 201380029337.9 [English translation and original document in Chinese], 16 pages.
Response, filed May 3, 2017, to Office Action, dated Jan. 20, 2017, in connection with Chinese Patent Application No. 201380029337.9 [English instructions, document as filed in Chinese and documents cited in response], 153 pages.
Response, filed Feb. 6, 2017, to Examination Report, dated Oct. 5, 2016, issued in connection with Eurasian Patent Application No. 201401096 [English instructions for response and Response as filed in Russian], 54 pages.
Letter, dated May 23, 2017, reporting Office Action, dated Apr. 27, 2017, issued in connection with Eurasian Patent Application No. 201401096 [English letter and original document in Russian], 15 pages.
Response, filed Feb. 27, 2017, to Communication pursuant to Article 94(3), dated Oct. 18, 2016, issued in connection with European Patent Application No. 13715069.4, 21 pages.
Communication pursuant to Article 94(3), dated May 11, 2017, issued in connection with European Patent Application No. 13715069.4, 4 pages.
Response, filed Aug. 16, 2017, to Communication pursuant to Article 94(3), dated May 11, 2017, issued in connection with European Patent Application No. 13715069.4, 51 pages.
Official Action, dated Apr. 18, 2017, in connection with Japanese Patent Application No. 2016-153512 [English translation and original document in Japanese], 7 pages.
Response, filed Mar. 20, 2017, to Office Action, dated Dec, 16, 2016, in connection with Korean Patent Application No. 10-2016-7006716 [English instructions and document as filed in Korean], 69 pages.
Response, filed Jan. 3, 2017, to Examination Report, dated Nov. 3, 2016, in connection with New Zealand Patent Application No. 723245, 39 pages.
Response, filed Apr. 29, 2017, to Examination Report, dated Jan. 30, 2017, in connection with New Zealand Patent Application No. 723245, 140 pages.
Examination Report, dated May 24, 2017, in connection with New Zealand Patent Application No. 723245, 5 pages.
Letter/Written Disclosure of the Supplemental Information Disclosure Statement for the above-referenced application, filed herewith on Oct. 18, 2017, 2 pages.
Office Action, dated Oct. 18, 2017, in connection with U.S. Appl. No. 15/625,177, 14 pages.
Response, filed Oct. 16, 2017, to Examiner's Report, dated Jul. 14, 2017, in connection with Canadian Patent Application No. 2,869,460, 13 pages.
Response, filed Aug. 24, 2017, to Examination Report, dated May 24, 2017, in connection with New Zealand Patent Application No. 723245, 28 pages.
Letter/Written Disclosure of the Supplemental Information Disclosure Statement for the above-referenced application, filed herewith on Oct. 18, 2016, 3 pages.
Examination Report, dated Sep. 14, 2017, in connection with New Zealand Patent Application No. 723245, 5 pages.
Letter/Written Disclosure of the Supplemental Information Disclosure Statement for the above-referenced application, filed herewith on Mar. 16, 2017, 3 pages.
Office Action, dated Dec. 16, 2016, in connection with Korean Patent Application No. 10-2016-7006716 [English translation and original document in Korean; D1=WO 2009/128917; D2=Desai et al. (2008)], 6 pages.
Office Action, dated Jan. 20, 2017; in connection with Chinese Patent Application No. 201380029337.9 [English translation and original document in Chinese], 16 pages.
Examination Report, dated Jan. 30, 2017, in connection with New Zealand Patent Application No. 723245, 4 pages.
Letter/Written Disclosure of the Supplemental Information Disclosure Statement for the above-referenced application, filed herewith on Nov. 10, 2017, 3 pages.
Decision to Grant, dated Oct. 11, 2017 and dated Oct. 24, 2017, in connection with corresponding Korean Patent Application No. 10-2016-7006716 [English translation], 3 pages.
Examiner's Report, dated Oct. 27, 2017 and dated Nov. 7, 2017, in connection with corresponding Canadian Patent Application No. 2,869,460, 5 pages.
Letter/Written Disclosure of the Supplemental Information Disclosure Statement for the above-referenced application, filed herewith on Jan. 5, 2018, 3 pages.
Office Action, dated Nov. 30, 2017, in connection with corresponding Chinese Patent Application No. 201380029337.9 [English translation and original document in Chinese], 12 pages.
Letter/Written Disclosure of the Supplemental Information Disclosure Statement for the above-referenced application, filed herewith on Jan. 10, 2018, 2 pages.
Hingorani et al., "HALO 202: Randomized Phase II Study of PEGPH2O Plus Nab-Paclitaxel/Gemcitabine Versus Nab-Paclitaxel/ Gemcitabine in Patients with Untreated, Metastatic Pancreatic Ductal Adenocarcinoma," J Clin Oncol doi: 10.1200/JCO.2017.74.9564. [Epub ahead of print] [Published online on Dec. 12, 2017], 12 pages.

* cited by examiner

COMBINATION THERAPY WITH AN ANTI-HYALURONAN AGENT AND THERAPEUTIC AGENT

RELATED APPLICATIONS

Benefit of priority is claimed to U.S. Provisional Application No. 61/686,429, filed Apr. 4, 2012, entitled "COMBINATION THERAPY WITH A POLYMER-CONJUGATED HYALURONAN-DEGRADING ENZYME AND THERAPEUTIC AGENT," and to U.S. Provisional Application No. 61/714,719, filed Oct. 16, 2012, entitled "COMBINATION THERAPY WITH AN ANTI-HYALURONAN AGENT AND THERAPEUTIC AGENT."

This application is related to International Patent Application Serial No. PCT/US2013/032684, filed the same day herewith, entitled "COMBINATION THERAPY WITH AN ANTI-HYALURONAN AGENT AND THERAPEUTIC AGENT," which claims priority to U.S. Provisional Application No. 61/686,429 and U.S. Provisional Application No. 61/714,719.

This application is related to U.S. patent application Ser. No. 12/386,222, entitled "MODIFIED HYALURONIDASES AND USES IN TREATING HYALURONAN-ASSOCIATED DISEASES AND CONDITIONS," filed on Apr. 14, 2009, which is published as US20100003238 and claims priority U.S. Provisional Appl. Nos. 61/124,278, 61/130,357 and 61/195,624. This application also is related to International PCT Application No. PCT/US2009/002352, filed Apr. 14, 2009, which is published as WO2009/128917 and also claims priority to U.S. Provisional Appl. Nos. 61/124,278, 61/130,357 and 61/195,624.

This application is related to U.S. patent application Ser. No. 13/135,817, entitled "ADVERSE SIDE-EFFECTS ASSOCIATED WITH ADMINISTRATION OF ANTI-HYALURONAN AGENTS AND METHODS FOR AMELIORATING OR PREVENTING THE SIDE-EFFECTS," filed on Jul. 15, 2011, which is published as US20120020951 and claims priority U.S. Provisional Appl. Nos. 61/399,993 and 61/455,260. This application also is related to International PCT Application No. PCT/US2011/044281, filed Jul. 15, 2011, which is published as WO2012/012300 and also claims priority to U.S. Provisional Appl. Nos. 61/399,993 and 61/455,260.

The subject matter of each of the above-noted applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy 1 and Copy 2), the contents of which are incorporated by reference in their entirety. The computer-readable file on each of the aforementioned compact discs, created on Mar. 15, 2013 is identical, 891 kilobytes in size, and titled 3108SEQ.001.txt. A substitute Sequence Listing, incorporated by reference in its entirety, is provided on identical compact discs (labeled Copy 1 Replacement Jul. 10, 2013 and Copy 2 Replacement Jul. 10, 2013). The computer-readable file on each of the aforementioned compact discs, created on Jul. 10, 2013, is identical, 892 kilobytes in size, and titled 3108SEQ.002.txt.

FIELD OF THE INVENTION

Provided herein is combination therapy containing an anti-hyaluronan agent, such as a polymer-conjugated hyaluronan-degrading enzyme, and a tumor-targeted taxane, and optionally a further chemotherapeutic agent such as a nucleoside analog. The combination therapy can be used in methods of treating cancers, and in particular solid tumor cancers.

BACKGROUND

Anti-hyaluronan agents, such as hyaluronan-degrading enzymes, e.g., PH20, are used in methods of treating hyaluronan-associated diseases or conditions, including cancers and in particular hyaluronan-associated cancers or tumors. Hyaluronan (hyaluronic acid; HA) is a glycosaminoglycan that exists predominantly in connective tissues, skin, cartilage, and in synovial fluid in mammals. In connective tissue, the water of hydration associated with hyaluronan creates hydrated matrices between tissues. HA is found in the extracellular matrix of many cells, especially in soft connective tissues. Certain diseases are associated with expression and/or production of hyaluronan, including solid tumors. Anti-hyaluronan agents are agents that modulate HA synthesis or degradation, thereby altering HA levels in a tissue or cell. Specically, hyaluronidases are enzymes that degrade hyaluronan. By catalyzing the breakdown of HA, hyaluronidases can be used to treat diseases or disorders associated with accumulation of HA or other glycosaminoglycans, including cancers and tumors. For the treatment of cancers, and in particular solid tumor cancers, there is a need for improved or alternative therapeutic treatments.

SUMMARY

Provided herein are combinations containing a composition containing an anti-hyaluronan agent and a composition containing a tumor-targeted taxane. Also provided herein are combinations containing a composition containing an anti-hyaluronan agent, a composition containing a tumor-targeted taxane and a composition containing a nucleoside analog. Any of the combinations provided herein can further contain a composition containing a corticosteroid. Provided herein are methods for treating a cancer wherein a composition containing an anti-hyaluronan agent and a composition containing a tumor-targeted taxane formulation are administered. In some examples, the methods further include administration of a composition containing a nucleoside analog. In some examples, the methods further include administration of a corticosteroid. In yet other examples, the methods further include administration of a cancer treatment. In such combinations and methods, the agents are provided in therapeutically effective amounts as described herein.

Also provided herein are medical uses of the combination therapy. For example, provided herein are uses of an anti-hyaluronan agent and tumor-targeted taxane for treating a cancer, wherein the anti-hyaluronan agent and tumor-targeted taxane are formulated separately or together. Also provided herein are uses of an anti-hyaluronan agent for treating cancer, wherein said treatment includes simultaneously, separately or sequentially administering to a subject a tumor targeted taxane. Also provided herein are compositions containing an anti-hyaluronan agent for use in the treatment of cancer, wherein said treatment includes simultaneously, separately or sequentially administering to a subject a tumor targeted taxane. In examples of medical uses herein, the treatment also can include administering to a subject a nucleoside analog simultaneously, separately or sequentially with the anti-hyaluronan agent or tumor-targeted taxane. In other or additional examples, the treatment can include administering a corticosteroid simultaneously, separately or sequentially with the anti-hyaluronan agent.

In the provided combinations, compositions, methods and uses herein, the anti-hyaluronan agent is a hyaluronan degrading enzyme or is an agent that inhibits hyaluronan synthesis. In some examples, the anti-hyaluronan agent is a hyaluronan degrading enzyme that is a hyaluronidase. In other examples, the anti-hyaluronan agent is a hyaluronan-degrading enzyme that is conjugated to a polymer. In some examples, the anti-hyaluronan agent is an agent that inhibits hyaluronan synthesis that is selected from a sense or antisense nucleic acid molecule against an HA synthase or is a small molecule drug. In some examples, the anti-hyaluronan agent is a small molecule drug selected from 4-methylumbelliferone (MU) or a derivative thereof, or leflunomide or a derivative thereof. In other examples, the anti-hyaluronan agent is a small molecule drug is a derivative of 4-methylumbelliferone (MU) selected from 6,7-dihydroxy-4-methyl coumarin or 5,7-dihydroxy-4-methyl coumarin.

Provided herein are combinations containing a composition containing a hyaluronan-degrading enzyme that is conjugated to a polymer and a composition containing a tumor-targeted taxane. Also provided herein are combinations containing a composition containing a hyaluronan-degrading enzyme that is conjugated to a polymer, a composition containing a tumor-targeted taxane and a composition containing a nucleoside analog. Any of the combinations provided herein can further contain a composition containing a corticosteroid. Provided herein are methods for treating a cancer wherein a composition containing a hyaluronan-degrading enzyme that is conjugated to a polymer and a composition containing a tumor-targeted taxane formulation are administered. In some examples, the methods further include administration of a composition containing a nucleoside analog. In some examples, the methods further include administration of a corticosteroid. In yet other examples, the methods further include administration of a cancer treatment.

Provided herein are combinations, methods and uses containing a composition containing a hyaluronan-degrading enzyme, wherein the hyaluronan-degrading enzyme is conjugated to a polymer; and a composition containing a tumor-targeted taxane. In some examples of the combination, the compositions are formulated for direct administration, the concentration of hyaluronan-degrading enzyme is sufficient to degrade tumor-associated hyaluronan, and the concentration of tumor-targeted taxane is sufficient to achieve intratumoral delivery. In some examples, the concentration of tumor-targeted taxane formulation is sufficient to reduce intratumoral nucleoside deaminase protein levels or protein activity compared to the levels or activity of the nucleoside deaminase in the absence of the intratumoral taxane formulation. In some examples of the combinations, the hyaluronan-degrading enzyme and tumor-targeted taxane are co-formulated. In other examples of the combinations, the hyaluronan-degrading enzyme and tumor-targeted taxane are provided separately.

In any of the examples, the provided combinations further contain a composition containing a nucleoside analog. In particular examples, the composition is formulated for direct administration and the concentration of nucleoside analog is sufficient to achieve intratumoral delivery. In some examples of the combination, the nucleoside analog is provided separately from the hyaluronan-degrading enzyme and tumor-targeted taxane. In other examples of the combination, the nucleoside analog is co-formulated with the hyaluronan-degrading enzyme or is co-formulated with the tumor-targeted taxane. In yet other examples of the combination, the nucleoside analog is co-formulated with the hyaluronan-degrading enzyme and the tumor-targeted taxane.

In any of the examples of the combinations, methods and uses provided herein, the compositions containing a hyaluronan-degrading enzyme, compositions containing a tumor-targeted taxane and/or compositions containing a nucleoside analog are formulated for multiple dosage administration. In other examples of the combinations provided herein, the compositions containing a hyaluronan-degrading enzyme, compositions containing a tumor-targeted taxane and/or compositions containing a nucleoside analog are formulated for single dosage administration.

In any of the examples of the combinations, methods and uses provided herein, the hyaluronan-degrading enzyme composition contains or is formulated to contain between or about between 0.5 µg to 50 mg, 100 µg to 1 mg, 1 mg to 20 mg, 100 µg to 5 mg, 0.5 µg to 1450 µg, 1 µg to 1000 µg, 5 µg to 1250 µg, 10 µg to 750 µg, 50 µg to 500 µg, 0.5 µg to 500 µg, 500 µg to 1450 µg hyaluronan-degrading enzyme conjugated to a polymer. In other examples of the combinations provided herein, the hyaluronan-degrading enzyme conjugated to a polymer has a specific activity of at least or about 20,000 U/mg, 25,000 U/mg, 30,000 U/mg, 31,000 U/mg, 32,000 U/mg, 33,000 U/mg, 34,000 U/mg, 35,000 U/mg, 36,000 U/mg, 37,000 U/mg, 38,000 U/mg, 39,000 U/mg, 40,000 U/mg, 45,000 U/mg, 50,000 U/mg, 55,000 U/mg, 60,000 U/mg or more. In further examples of the combinations provided herein, the hyaluronan-degrading enzyme composition contains between or about between 150 Units (U) to 60,000 U, 300 U to 30,000 U, 500 U to 25,000 U, 500 U to 10,000 U, 150 U to 15,000 U, 150 U to 5000 U, 500 U to 1000 U, 5000 U to 45,000 U 10,000 U to 50,000 U or 20,000 U to 60,000 U hyaluronan-degrading enzyme conjugated to a polymer. The volume of the composition containing the hyaluronan-degrading enzyme can be between or can be about between 0.5 mL to 100 mL, 0.5 mL to 50 mL, 0.5 mL to 10 mL, 1 mL to 40 mL, 1 mL to 20 mL, 1 mL to 10 mL, or 3 mL to 10 mL. In some examples of the combinations provided herein, the composition containing a hyaluronan-degrading enzyme contains histidine and/or NaCl. In other examples, the composition containing a hyaluronan-degrading enzyme has a pH that is between or about between 6.0 to 7.4

In any of the examples of the combinations, methods and uses provided herein, the hyaluronan-degrading enzyme is a hyaluronidase. For example, the hyaluronidase can be a PH20 or truncated form thereof that lacks a C-terminal glycosylphosphatidylinositol (GPI) attachment site or a portion of the GPI attachment site. In some examples, the hyaluronidase is a PH20 that is a human or non-human PH20. In a specific example, the hyaluronan-degrading enzyme is a truncated PH20 and the truncated PH20 contains a sequence of amino acids that contains amino acids 36-464 of SEQ ID NO:1, or contains a sequence of amino acids that has at least 85% sequence identity to a sequence of amino acids that contains at least amino acids 36-464 of SEQ ID NO:1 and retains hyaluronidase activity. In some examples, the hyaluronidase is PH20 that contains a sequence of amino acids that has at least 86%, 87%, 88%, 89%, 90%, 91%, 92%, 93%, 94%, 95%, 96%, 97%, 98% or 99% sequence identity to a sequence of amino acids that contains at least amino acids 36-464 of SEQ ID NO:1 and retains hyaluronidase activity.

In any of the examples of the combinations, methods and uses provided herein, the PH20 contains a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1, or is a variant thereof that exhibits at least 85% sequence identity to a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity. For example, the PH20 contains a sequence of amino acids that has at least 86%, 87%, 88%, 89%, 90%, 91%, 92%, 93%, 94%, 95%, 96%, 97%, 98% or 99% sequence identity to a sequence of amino acids that contains that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity.

In any of the examples of the combinations, methods and uses provided herein, the tumor-targeted taxane is paclitaxel or docetaxel or is an analog, derivative or prodrug thereof. The tumor-targeted taxane can be linked directly or indirectly to a tumor targeting moiety. In some examples, the tumor-targeted taxane is formulated as a delivery vehicle selected from among a micelle, nanoparticle, microsphere, liposomes or hydrogel. The delivery vehicle can be linked directly or indirectly to a tumor targeting moiety. In some examples, the tumor targeting moiety is selected from among a macromolecule, a protein, a peptide, a monoclonal antibody or a fatty acid lipid. In other examples, the tumor targeting moiety is a monoclonal antibody selected from among cetuximab or trastuzumab. In yet other examples, the tumor targeting moiety is albumin. In some examples, the tumor-targeted taxane is albumin-bound paclitaxel or albumin-bound docetaxel.

In any of the examples of the combinations, methods and uses provided herein, the tumor-targeted taxane composition contains or is formulated to contain between or about between 10 mg to 1000 mg, such as 20 mg to 500 mg, 10 mg to 250 mg, 75 mg to 400 mg, 100 mg to 200 mg, 150 mg to 400 mg, 200 mg to 800 mg, 50 mg to 200 mg or 50 mg to 150 mg tumor-targeted taxane. In other examples, the volume of the composition containing a tumor targeted taxane is between or about between 0.5 mL to 100 mL, 1 mL to 500 mL, 0.5 mL to 50 mL, 0.5 mL to 10 mL, 1 mL to 40 mL, 1 mL to 20 mL, 1 mL to 10 mL, or 3 mL to 10 mL In any of the examples of the combinations, methods and uses provided herein, the nucleoside analog is a purine or pyrimidine analog or derivatives thereof. In some examples, the nucleoside analog is selected from among fluoropyrimidine 5-fluorouracil, 5-fluoro-2'-deoxycytidine, cytarabine, gemcitabine, troxacitabine, decitabine, Azacytidine, pseudoisocytidine, Zebularine, Ancitabine, Fazarabine, 6-azacytidine, capecitabine, N4-octadecyl-cytarabine, elaidic acid cytarabine, fludarabine, cladribine, clofarabine, nelarabine, forodesine, and pentostatin, or derivatives thereof. In one example, the nucleoside analog is a substrate for a nucleoside deaminase that is adenosine deaminase or cytidine deaminase. In some examples, the nucleoside analog is selected from among fludarabine, cytarabine, gemcitabine, decitabine and azacytidine or derivatives thereof.

In any of the examples of the combinations, methods and uses provided herein, the nucleoside analog composition contains or is formulated to contain 100 mg to 5000 mg, 500 mg to 5000 mg, 500 mg to 2500 mg, 1000 mg to 2500 mg, 1500 mg to 2500 mg or 2000 mg to 5000 mg of a nucleoside analog. In other examples, the volume of the composition containing a nucleoside analog is between or about between 0.5 mL to 1000 mL, such as 0.5 mL to 100 mL, 0.5 mL to 10 mL, 1 mL to 500 mL, 1 mL to 10 mL.

Any of the combinations, methods and uses provided herein can further contain a composition containing a corticosteroid. In some examples, the corticosteroid is a glucocorticoid that is selected from among cortisones, dexamethasones, hydrocortisones, methylprednisolones, prednisolones and prednisones. In some examples, the corticosteroid composition contains or is formulated to contain between at or about 0.1 to 20 mgs, 0.1 to 15 mgs, 0.1 to 10 mgs, 0.1 to 5 mgs, 0.2 to 20 mgs, 0.2 to 15 mgs, 0.2 to 10 mgs, 0.2 to 5 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs corticosteroid.

In any of the examples of the combinations, method and uses provided herein, the composition(s) is (are) formulated for administration orally, intravenously (IV), subcutaneously, intramuscularly, intra-tumorally, intradermally, topically, transdermally, rectally, intrathecally or sub-epidermally. For example, the composition(s) is (are) formulated for intravenous administration or subcutaneous administration.

In any of the examples of the combinations, methods and uses herein provided herein, the polymer is a polyalkylene glycol, dextran, pullulan or cellulose. In one example, the polymer is a polyalkylene glycol that is selected from among polyethylene glycols (PEG) or methoxypolyethylene glycols (mPEG). In a specific example, the polymer is a PEG, and the PEG is a branched or linear PEG. In some examples, the polymer is produced by reaction with methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly (ethylene glycol)-butyraldehyde (mPEG-butyraldehyde) (30 kDa), methoxy-poly (ethylene glycol)-succinimidyl propionate (mPEG-SPA) (20 kDa); methoxy-poly (ethylene glycol)-succinimidyl propionate (mPEG-SPA) (30 kDa); (methoxy-poly (ethylene glycol))$_2$-N-hydroxysuccinimide ester (mPEG$_2$-NHS) (10 kDa branched); (methoxy-poly(ethylene glycol))$_2$-N-hydroxysuccinimide ester (mPEG$_2$-NHS) (20 kDa branched); (methoxy-poly(ethylene glycol))$_2$- N-hydroxysuccinimide ester (mPEG$_2$-NHS) (40 kDa branched); (methoxy-poly (ethylene glycol))$_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly(ethylene glycol)-priopionaldehyde (PEG-propionaldehyde) (30 kDa). In specific examples, the polymer is a PEG that has a molecular weight of 30 or about 30 kilodaltons.

Any of the combinations provided herein can be packaged as a kit and optionally include instructions for use.

Also provided herein are methods or uses for treating a cancer wherein a composition containing a hyaluronan-degrading enzyme, wherein the hyaluronan-degrading enzyme is conjugated to a polymer is administered and a composition containing a tumor-targeted taxane formulation is administered. In any of the examples of the method, a composition containing a nucleoside analog is also administered.

In any of the examples of the provided methods or uses herein, the cancer is a tumor. In one example, the tumor is a solid tumor. In any of the examples of the method or uses herein, the tumor has increased cellular and/or stromal expression of a hyaluronan, compared to a non-cancerous tissue of the same tissue type or compared to a non-metastatic tumor of the same tumor-type. In any of the examples of the methods or uses provided herein, the cancer is selected from among pancreatic cancer, ovarian cancer, lung cancer, colon cancer, prostate cancer, cervical cancer, head and neck cancer and breast cancer. In a specific example, the cancer is pancreatic cancer.

In any of the examples of the methods or uses provided herein, the hyaluronan-degrading enzyme is a hyaluronidase. For example, the hyaluronidase is a PH20 or truncated form thereof that lacks a C-terminal glycosylphosphatidylinositol (GPI) attachment site or a portion of the GPI attachment site. In a specific example, the hyaluronidase is a PH20 that is a human or non-human PH20. In a particular example, the hyaluronan-degrading enzyme is a truncated PH20 and the truncated PH20 contains a sequence of amino acids that contains amino acids 36-464 of SEQ ID NO:1, or contains a sequence of amino acids that has at least 85% sequence identity to a sequence of amino acids that contains at least amino acids 36-464 of SEQ ID NO:1 and retains hyaluronidase activity. In some examples, the PH20 contains a sequence of amino acids that has at least 86%, 87%, 88%, 89%, 90%, 91%, 92%, 93%, 94%, 95%, 96%, 97%, 98% or 99% sequence identity to a sequence of amino acids that contains at least amino acids 36-464 of SEQ ID NO:1 and retains hyaluronidase activity. In other examples, the PH20 contains a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1, or is a variant thereof that exhibits at least 85% sequence identity to a sequence of amino acids that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity. In yet other examples, the PH20 contains a sequence of amino acids that has at least 86%, 87%, 88%, 89%, 90%, 91%, 92%, 93%, 94%, 95%, 96%, 97%, 98% or 99% sequence identity to a sequence of amino acids that contains that contains a C-terminal truncation after amino acid position 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO:1 and retains hyaluronidase activity.

In any of the examples of the methods or uses provided herein, the polymer is a polyalkylene glycol, dextran, pullulan or cellulose. In one example, the polymer is a polyalkylene glycol that is selected from among polyethylene glycols (PEG) or methoxypolyethylene glycols (mPEG). In a specific example, the polymer is a PEG, and the PEG is a branched or linear PEG. In any of the examples of the methods or uses provided herein, the polymer is producd by reaction with methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy-poly(ethylene glycol)-succinimidyl propionate (mPEG-SPA) (20 kDa); methoxy-poly(ethylene glycol)-succinimidyl propionate (mPEG-SPA) (30 kDa); (methoxy-poly(ethylene glycol)) 2-N-hydroxysuccinimide ester (mPEG2-NHS) (10 kDa branched); (methoxy-poly(ethylene glycol)) 2-N-hydroxysuccinimide ester (mPEG2-NHS) (20 kDa branched); (methoxy-poly(ethylene glycol)) 2-N-hydroxysuccinimide ester (mPEG2-NHS) (40 kDa branched); (methoxy-poly(ethylene glycol)) 2-N-hydroxysuccinimide ester (mPEG2-NHS) (60 kDa branched); biotin-poly(ethylene glycol)-N-hydroxysuccinimide ester (biotin-PEG-NHS) (5 kDa biotinylated); poly(ethylene glycol)-p-nitrophenyl carbonate (PEG-p-nitrophenyl-carbonate) (30 kDa); or poly(ethylene glycol)-priopionaldehyde (PEG-propionaldehyde) (30 kDa). In a specific example, the polymer is a PEG that has a molecular weight of 30 or about 30 kilodaltons.

In any of the examples of the methods or uses provided herein, the hyaluronan-degrading enzyme is administered in or is formulated for administration in a dosage range amount of between or about between 0.01 μg/kg to 25 mg/kg (of the subject), 0.5 μg/kg to 25 mg/kg, 0.5 μg/kg to 10 mg/kg, 0.02 mg/kg to 1.5 mg/kg, 0.01 μg/kg to 15 μg/kg, 0.05 μg/kg to 10 μg/kg, 0.75 μg/kg to 7.5 μg/kg or 1.0 μg/kg to 3.0 μg/kg (of the subject). In any of the examples of the methods or uses provided herein, the hyaluronan-degrading enzyme is administered in or is formulated for administration in a dosage range amount of between or about between 1 Unit/kg to 800,000 Units/kg (of the subject), such as 10 to 800,000 Units/kg, 10 to 750,000 Units/kg, 10 to 700,000 Units/kg, 10 to 650,000 Units/kg, 10 to 600,000 Units/kg, 10 to 550,000 Units/kg, 10 to 500,000 Units/kg, 10 to 450,000 Units/kg, 10 to 400,000 Units/kg, 10 to 350,000 Units/kg, 10 to 320,000 Units/kg, 10 to 300,000 Units/kg, 10 to 280,000 Units/kg, 10 to 260,000 Units/kg, 10 to 240,000 Units/kg, 10 to 220,000 Units/kg, 10 to 200,000 Units/kg, 10 to 180,000 Units/kg, 10 to 160,000 Units/kg, 10 to 140,000 Units/kg, 10 to 120,000 Units/kg, 10 to 100,000 Units/kg, 10 to 80,000 Units/kg, 10 to 70,000 Units/kg, 10 to 60,000 Units/kg, 10 to 50,000 Units/kg, 10 to 40,000 Units/kg, 10 to 30,000 Units/kg, 10 to 20,000 Units/kg, 10 to 15,000 Units/kg, 10 to 12,800 Units/kg, 10 to 10,000 Units/kg, 10 to 9,000 Units/kg, 10 to 8,000 Units/kg, 10 to 7,000 Units/kg, 10 to 6,000 Units/kg, 10 to 5,000 Units/kg, 10 to 4,000 Units/kg, 10 to 3,000 Units/kg, 10 to 2,000 Units/kg, 10 to 1,000 Units/kg, 10 to 900 Units/kg, 10 to 800 Units/kg, 10 to 700 Units/kg, 10 to 500 Units/kg, 10 to 400 Units/kg, 10 to 300 Units/kg, 10 to 200 Units/kg, 10 to 100 Units/kg, 16 to 600,000 Units/kg, 16 to 500,000 Units/kg, 16 to 400,000 Units/kg, 16 to 350,000 Units/kg, 16 to 320,000 Units/kg, 16 to 160,000 Units/kg, 16 to 80,000 Units/kg, 16 to 40,000 Units/kg, 16 to 20,000 Units/kg, 16 to 16,000 Units/kg, 16 to 12,800 Units/kg, 16 to 10,000 Units/kg, 16 to 5,000 Units/kg, 16 to 4,000 Units/kg, 16 to 3,000 Units/kg, 16 to 2,000 Units/kg, 16 to 1,000 Units/kg, 16 to 900 Units/kg, 16 to 800 Units/kg, 16 to 700 Units/kg, 16 to 500 Units/kg, 16 to 400 Units/kg, 16 to 300 Units/kg, 16 to 200 Units/kg, 16 to 100 Units/kg, 160 to 12,800 Units/kg, 160 to 8,000 Units/kg, 160 to 6,000 Units/kg, 160 to 4,000 Units/kg, 160 to 2,000 Units/kg, 160 to 1,000 Units/kg, 160 to 500 Units/kg, 500 to 5000 Units/kg, 1000 to 100,000 Units/kg or 1000 to 10,000 Units/kg (of the subject).

In any of the examples of the methods or uses provided herein, the tumor-targeted taxane is paclitaxel or docetaxel or is an analog, derivative or prodrug thereof. The tumor-targeted taxane can be linked directly or indirectly to a tumor targeting moiety. In some examples, the tumor-targeted taxane is formulated as a delivery vehicle selected from among a micelle, nanoparticle, microsphere, liposomes or hydrogel. The delivery vehicle can be linked directly or indirectly to a tumor targeting moiety. In some examples, the tumor targeting moiety is selected from among a macromolecule, a protein, a peptide, a monoclonal antibody or a fatty acid lipid. In other examples, the tumor targeting moiety is a monoclonal antibody selected from among cetuximab or trastuzumab. In yet another example, the tumor targeting moiety is albumin. In a particular example, the tumor-targeted taxane is albumin-bound paclitaxel or albumin-bound docetaxel. In any of the examples of the methods or uses provided herein the tumor-targeted taxane is administered in or is formulated for administration in a dosage range that is between or about between 1 mg/m$^2$ to 1000 mg/m$^2$ (body surface area of the subject), 10 mg/m$^2$ to 500 mg/m$^2$, 50 mg/m$^2$ to 400 mg/m$^2$, or 25 mg/m$^2$ to 300 mg/m$^2$.

In any of the examples of the methods or uses provided herein, the nucleoside analog is a purine or pyrimidine analog or derivatives thereof. In any of the examples, the nucleoside analog is selected from among fluoropyrimidine 5-fluorouracil, 5-fluoro-2'-deoxycytidine, cytarabine, gemcitabine, troxacitabine, decitabine, Azacytidine, pseudoisocytidine, Zebularine, Ancitabine, Fazarabine, 6-azacytidine, capecitabine, N4-octadecyl-cytarabine, elaidic acid cytarabine, fludarabine, cladribine, clofarabine, nelarabine, forodesine, and pentostatin, or derivatives thereof. In a particular example, the nucleoside analog is a substrate for a nucleoside deaminase and the nucleoside deaminase is adenosine deaminase or cytidine deaminase. In examples, the nucleoside analog is selected from among fludarabine, cytarabine, gemcitabine, decitabine and azacytidine or derivatives thereof. In yet other examples, the nucleoside analog is gemcitabine or a derivative thereof. In any of the examples of the methods or uses provided herein, the nucleoside analog is administered in or is formulated for administration in a dosage range that is between or between about 100 mg/m$^2$ to 2500 mg/m$^2$, 500 mg/m$^2$ to 2000 mg/m$^2$, 750 mg/m$^2$ to 1500 mg/m$^2$, 1000 mg/m$^2$ to 1500 mg/m$^2$, or 500 mg/m$^2$ to 1500 mg/m$^2$. In other examples of the methods or uses provided herein, the nucleoside analog is administered in or is formulated for administration in an amount that is at least or at least about 200 mg/m$^2$ or 500 mg/m$^2$ but that is less than 1000 mg/m$^2$ or 1250 mg/m$^2$.

In any of examples of the methods or uses provided herein, composition(s) is (are) administered or are formulated for administration orally, intravenously (IV), subcutaneously, intramuscularly, intra-tumorally, intradermally, topically, transdermally, rectally, intrathecally or sub-epidermally. In a particular example, the composition(s) is (are) administered intravenously or subcutaneously. In any of the methods or uses herein, the hyaluronan-degrading enzyme is administered or is used prior to, simultaneously or near simultaneously, sequentially or intermittently with the tumor-targeted taxane.

In examples of the methods provided herein, the hyaluronan-degrading enzyme is administered prior to administration of the tumor-targeted taxane. In one example, the hyaluronan-degrading enzyme is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours prior to administration of the tumor-targeted taxane. In another example of the methods provided herein, the hyaluronan-degrading enzyme and tumor-targeted taxane are administered simultaneously or near simultaneously.

In any of the examples of the methods provided herein, the frequency of administration of the hyaluronan-degrading enzyme is twice weekly, once weekly, once every 14 days, once every 21 days or once every month. In other examples, the frequency of administration of the tumor-targeted taxane is twice weekly, once weekly, once every 14 days, once every 21 days or once every month. In any of the examples of the methods or uses provided herein, the hyaluronan-degrading enzyme and/or tumor-targeted taxane is administered or is formulated for administration prior to, simultaneously or near simultaneously, sequentially, or intermittently with the nucleoside analog.

In any of the examples of the methods or uses provided herein, the hyaluronan-degrading enzyme and tumor-targeted taxane are administered for a predetermined number of weeks in a cycle of administration. In one example, the predetermined number of weeks can be at least two weeks, at least three weeks or at least four weeks. In some examples, the hyaluronan-degrading enzyme is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours prior to administration of the nucleoside analog. In some examples, the tumor-targeted taxane is administered at least or at least about or about or 1 hour, 2 hours, 3 hours, 4 hours, 6 hours, 8 hours, 12 hours, 16 hours, 18 hours, 20 -hours, 22 hours or 24 hours prior to administration of the nucleoside analog. In a particular example, the tumor-targeted taxane is administered simultaneously or near simultaneously with the nucleoside analog. In the provided methods, the frequency of administration of the nucleoside analog can be twice weekly, once weekly, once every 14 days, once every 21 days or once every month. In some examples, the nucleoside analog is administered for a predetermined number of weeks in a cycle of administration. For example, the predetermined number of weeks can be at least two weeks, at least three weeks or at least four weeks. In another example of the methods provided herein, after the predetermined number of weeks of administration of the nucleoside analog, administration is discontinued for a first predetermined period of time, and then resumed for at least one week.

In particular examples of the methods or uses provided herein, the hyaluronan-degrading enzyme and tumor-targeted taxane are administered prior to administration of the nucleoside analog; administered simultaneously or near simultaneously; and administered at a frequency of administration of twice weekly or once weekly for a predetermined number of weeks. In some examples, the predetermined number of weeks is four weeks. In such examples, the nucleoside analog is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours after administration of the hyaluronan-degrading enzyme and tumor-targeted taxane.

In any of the examples of the methods or uses provided herein, the nucleoside analog is administered once weekly for a predetermined number of weeks. In one example, the predetermined number of weeks is three weeks. In such examples, the administration can be discontinued for at least one week.

In any of the methods or uses provided herein, the cycle of administration and/or discontinuation of administration can be repeated a plurality of times. In some examples, the frequency of administration in the first cycle of administration is the same of differentthan the frequency of administration in subsequent cycles of administration. For example, frequency of administration is twice weekly in the first cycle of administration and once weekly for subsequent cycles of administration.

Any of the methods or uses provided herein can further include a step of administering a corticosteroid or a treatment that includes administering a corticosteroid. In any of such examples, the corticosteroid is a glucocorticoid that can be selected from among cortisones, dexamethasones, hydrocortisones, methylprednisolones, prednisolones and prednisones. In some examples of the method, the corticosteroid is administered prior to, concurrent with, intermittently with or subsequent to administration of hyaluronan-degrading enzyme. In one example, the corticosteroid is co-administered with the hyaluronan-degrading enzyme. In another example, the corticosteroid is administered at least or about at least 1 hour prior to administration of the hyaluronan-degrading enzyme. In another example of the provided methods, the corticosteroid is administered at least 8 hours to 12 hours after administration of the hyaluronan-degrading enzyme. In some examples, the amount of corticosteroid administered is or that is formulated for administration is between at or about 0.1 to 20 mgs, 0.1 to 15 mgs, 0.1 to 10 mgs, 0.1 to 5 mgs, 0.2 to 20 mgs, 0.2 to 15 mgs, 0.2 to 10 mgs, 0.2 to 5 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs. The corticosteroid can be administered orally.

Any of the methods or uses provided herein can further include administration of a cancer treatment. In some examples, the cancer treatment is selected from among surgery, radiation, a chemotherapeutic agent, a biological agent, a polypeptide, an antibody, a peptide, a small molecule, a gene therapy vector, a virus and DNA. Any of the methods provided herein can be used to treat a subject that is a human.

Also provided herein are uses of the combinations of compositions provided herein can for treating a cancer. Any of the combinations of compositions provided herein can be used for treating cancer. In some examples the cancer is a tumor. For example, the cancer is a solid tumor. In some examples, the tumor has increased cellular and/or stromal expression of a hyaluronan, compared to a non-cancerous tissue of the same tissue type or compared to a non-metastatic tumor of the same tumor-type. In some examples, the cancer is selected from among pancreatic cancer, ovarian cancer, lung cancer, colon cancer, prostate cancer, cervical cancer, head and neck cancer and breast cancer. In a particular example, the cancer is pancreatic cancer. Also provided herein is the use of a combination containing a hyaluronan-degrading enzyme conjugated to a polymer and a composition containing a tumor-targeted taxane for increasing intratumoral activity of a nucleoside analog.

BRIEF DESCRIPTION OF THE FIGURES

FIG. 6 (A-B) depicts tumor growth inhibition of PEGPH20 and albumin-conjugated paclitaxel (Ab-pac) in a xenograft model.

DETAILED DESCRIPTION

Figure 1:
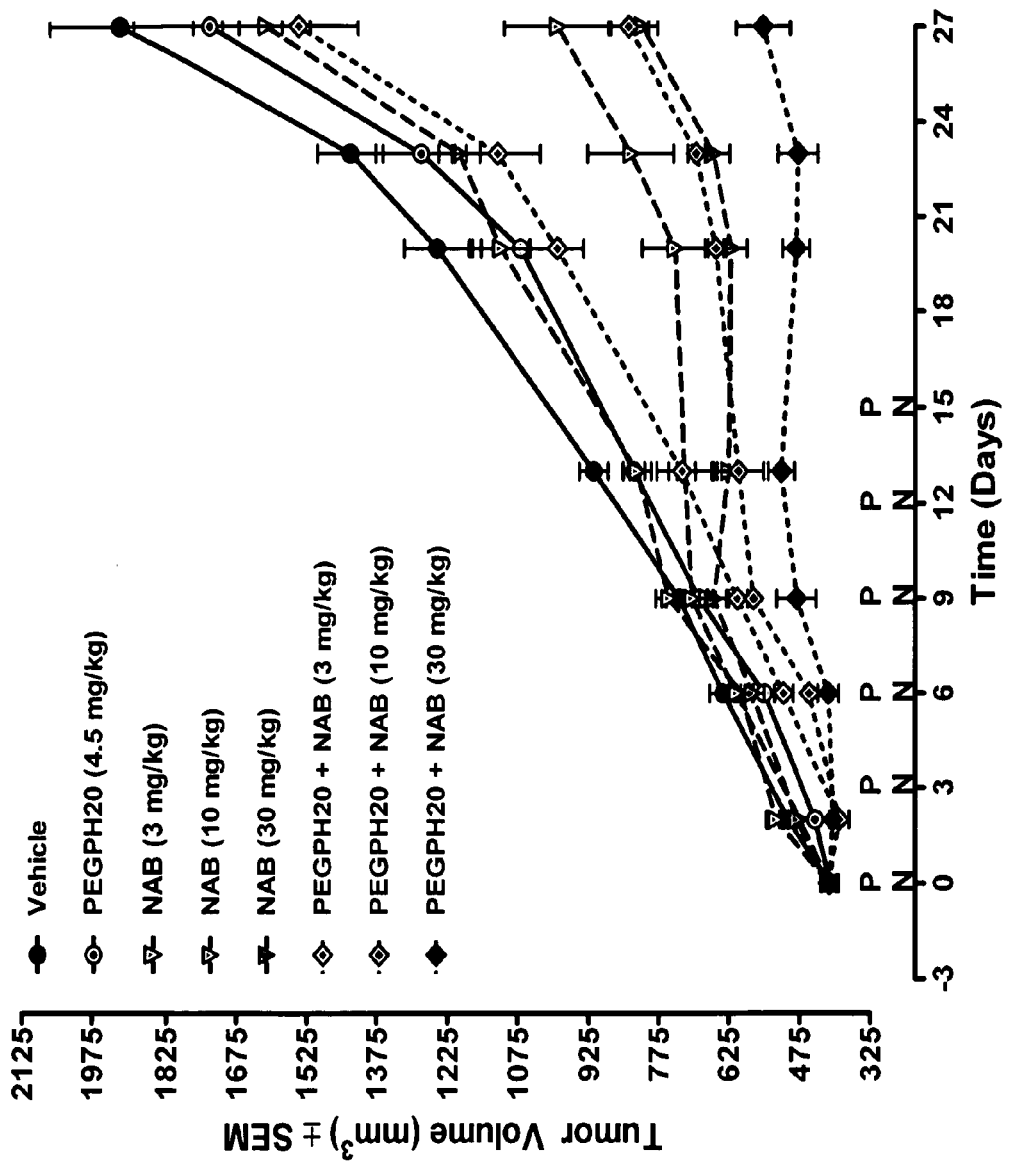
FIG. 1 depicts the effect of PEGPH20 (P) and/or nab-paclitaxel (NAB, N) on tumor growth in a mouse BxPC-3 PDA tumor xenograft model.

Outline
A. Definitions
B. Anti-Hyaluronan Agent Combination Therapy
  1. Solid Tumors and Tumor Targeted Therapies
    a. Tumor-Targeted Taxane
    b. Anti-Hyaluronan Agent
  2. Anti-Hyaluronan Agent and Tumor-Targeted Taxane Combination Therapy
C. Combination Therapy Agents
  1. Anti-Hyaluronan Agents
    a. Agents that Inhibit Hyaluronan Synthesis
    b. Hyaluronan-Degrading Enzymes and Polymer-Conjugated Hyaluronan-Degrading Enzymes
      i. Hyaluronidases
        (a) Mammalian-type hyaluronidases PH20
        (b) Bacterial Hyaluronidase
        (c) Hyaluronidases from leeches, other parasites and crustaceans
      ii. Other hyaluronan degrading enzymes
      iii. Soluble hyaluronan degrading enzymes
        (a) Soluble Human PH20
        (b) HuPH20
      iv. Glycosylation of hyaluronan degrading enzymes
      v. Modified (Polymer-Conjugated) Hyaluronan Degrading Enzymes
        PEGylated Soluble hyaluronan degrading enzymes
  2. Taxanes and Formulations thereof
    a. Taxanes
    b. Tumor- or Stromal-Targeted Taxanes Albumin-Bound Taxane
  3. Further Chemotherapeutic Agent (e.g. Nucleoside Analog) Exemplary Nucleoside Analogs
    i. Gemcitabine
    ii. Cytarabine
    ii. Decitabine
    iv. Azacytidine D. Methods of Producing Nucleic Acids and Encoded Polypeptides of Hyaluronan Degrading Enzymes
  1. Vectors and Cells
  2. Expression
     a. Prokaryotic Cells
     b. Yeast Cells
     c. Insect Cells
     d. Mammalian cells
     e. Plants
  3. Purification Techniques
  4. PEGylation of Hyaluronan Degrading Enzyme Polypeptides
E. Pharmaceutical Compositions and Formulations
  1. Formulations
     a. Injectables, solutions and emulsions
     b. Lyophilized powders
     c. Topical administration
     d. Compositions for other routes of administration
  2. Formulation Amounts
  3. Packaging and Articles of Manufacture
F. Methods of Assessing Activity, Bioavailability and Pharmacokinetics
  1. In Vitro Assays
     a. Hyaluronidase Activity of a Hyaluronan Degrading Enzyme
     b. Taxane Activity
     c. Anticancer Activity
  2. In Vivo Animal Models
  3. Pharmacokinetics and tolerability
G. Methods and Uses of Combination Therapy
  1. Cancers Selection of Subjects for Treatment
  2. Dosage and Administration
  3. Dosage Regimen: Frequency and Cycle of Administration
  4. Additional Combination Therapy
     a. Corticosteroid
     b. Anti-Cancer Agents and Other Treatments
H. Examples
A. Definitions Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, "combination therapy" refers to a treatment in which a subject if given two or more therapeutic agents, such as at least two or at least three therapeutic agents, for treating a single disease. For purposes herein, combination therapy includes therapy with a polymer-conjugated hyaluronan degrading enzyme and a tumor-targeted taxane and optionally a further anti-cancer agent or chemotherapeutic agent such as a nucleoside analog.

As used herein, a taxane refers to a family of antimitotic or antimicrotubule agents that inhibit cell growth by stopping mitosis and cell division due to interference with microtubule polymerization. Taxanes include naturally produced diterpenes produced from the plants of the genus *Taxus* (yews). Taxanes also include taxanes that are produced synthetically that exhibit antimitotic or antimicrotubule activity. Typically, taxanes share a common core structure containing four rings (six membered A and C rings, eight membered B ring and four membered D ring). Exemplary of a taxane is paclitaxel, taxane or a derivative or analog thereof.

As used herein, antimitotic activity refers to inhibiting, reducing or preventing mitosis. By virtue of such activity, cell growth is inhibited, reduced or prevented. For example, an agent exhibits antimitotic activity if cell growth is inhibited by at least or about at least or 20%, 30%, 40%, 50%, 60%, 70%, 80%, 90% or more compared to cell growth in the absence of the agent.

As used herein, antimicrotubule activity refers to the activity of any agent that interferes with microtubules, such as by decreasing, reducing or preventing microtubule polymerization. Hence, antimicrotubule activity can refer to any activity that stabilizes microtubules, which are naturally unstable and that undergo dynamic depolymerization (shortening) and polymerization (lengthening) processes. For example, antimicrotubule activity is effected by agents, such as taxanes, that interact with the ends of microtubules, thereby freezing or preventing disassembly or assembly. Assays to assess microtubule polymerization are known in the art, and exemplary assays described herein. Antimicrotubule activity exists if an agent inhibits microtubule polymerization by at least or about at least or 20%, 30%, 40%, 50%, 60%, 70%, 80%, 90% or more compared to polymerization in the absence of the agent.

As used herein, a "tumor-targeted taxane" refers to taxane that is linked, directly or indirectly, to a moiety and that exhibits increased specificity with one or more molecules on the surface of a tumor compared to the taxane that is not linked to the tumor moiety. For example, the moiety can be a macromolecule, peptide, protein, antibody (e.g. monoclonal antibody) or lipid that interacts or binds (e.g. specifically binds) with a molecule present on the surface of a tumor such as a sugar, lipid, glycosaminoglycan or protein present on the tumor surface. Generally, the molecule that is present on the surface of the tumor is present at a level or to an extent that is aberrant or distinct from non-tumor tissues or normal tissues or cells.

As used herein, the phrase "sufficient to achieve intratumoral delivery" means that the taxane exhibits increased or greater targeting to a tumor cell than to a non-tumor cell, and thus exhibits increased or greater intracellular localization therein. Assays to assess intratumoral delivery can include in vitro or in vivo assays, such as binding assay or subcellular localization assays whereby the bound- or intracellular level or amount of a drug, such as a taxane, is compared between normal cells and tumor cells. Such assays include, but are not limited to, immunoassays, including radioimmunoassays or ELISAs (e.g. lysate-based ELISAs and infrared ELISAs; see also Svojanovsky et al. (1999) *Journal of Pharmaceutical and Biomedical Analysis*, 20:549-555); tubulin-based bioassay (see e.g. Suye et al. (1997) Anal. Chem., 69:3633-3635); histochemistry or immunohistochemistry (Hong et al. (2007) *Mol. Cancer. Ther.*, 6: 3239); HPLC; fluorescent-based assays, including flow cytometry and other methods (see e.g. Sheikh et al. (2001) *Biosensors & Bioelectronics*, 16:647-652), and other similar assays known to one of skill in the art. Antibodies to taxane for use in such methods are available (see e.g. Grothaus et al. (1995) J Nat. Prod., 58:1003-14; Leu et al. (1993) *Cancer Res.*, 53:1388-1391; Catalog No. ab26953, Abcam). Biosensor technology also can be used (see e.g. Braunhut et al. (2005) *Assay and Drug*

*Dev. Tech.*, 3: 77-88). Assays also can include indirect assays, whereby the activity of the taxane on cellular machinery is assessed, including effects on tumor cell apoptosis and tumor growth, including tumor size or volume.

As used herein, an anti-hyaluronan agent refers to any agent that modulates hyaluronan (HA) synthesis or degradation, thereby altering hyaluronan levels in a tissue or cell. For purposes herein, anti-hyaluronan agents reduce hyaluronan levels in a tissue or cell compared to the absence of the agent. Such agents include compounds that modulate the expression of genetic material encoding HA synthase (HAS) and other enzymes or receptors involved in hyaluronan metabolism, or that modulate the proteins that synthesize or degrade hyaluronan including HAS function or activity. The agents include small-molecules, nucleic acids, peptides, proteins or other compounds. For example, anti-hyaluronan agents include, but are not limited to, antisense or sense molecules, antibodies, enzymes, small molecule inhibitors and HAS substrate analogs.

As used herein, a "conjugate" refers to a polypeptide linked directly or indirectly to one or more other polypeptides or chemical moieties. Such conjugates include fusion proteins, those produced by chemical conjugates and those produced by any other methods. For example, a conjugate refers to hyaluronan-degrading enzyme, such as a hyaluronidase or soluble PH20 polypeptide, linked directly or indirectly to one or more other polypeptides or chemical moieties, whereby at least one soluble PH20 polypeptide is linked, directly or indirectly to another polypeptide or chemical moiety so long as the conjugate retains hyaluronidase activity.

As used herein, a "polymer-conjugated hyaluronan-degrading enzyme" refers to a hyaluronan-degrading enzyme that is linked directly or indirectly to a polymer. The linkage can be any type of linkage, including, but not limited to, ionic and covalent bonds, and any other sufficiently stable associated interaction. Reference to a polymer-conjugated hyaluronan-degrading enzyme means that the conjugate exhibits hyaluronidase activity. Typically, the polymer-conjugate exhibits at least 20%, 30%, 40%, 50%, 60%, 70%, 80%, 90% or more of the hyaluronidase activity compared to the hyaluronan-degrading enzyme that is not conjugated to a polymer.

As used herein, a hyaluronan degrading enzyme refers to an enzyme that catalyzes the cleavage of a hyaluronan polymer (also referred to as hyaluronic acid or HA) into smaller molecular weight fragments. Exemplary of hyaluronan degrading enzymes are hyaluronidases, and particular chondroitinases and lyases that have the ability to depolymerize hyaluronan. Exemplary chondroitinases that are hyaluronan degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase comprises two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO:98; Sato et al. (1994) *Appl. Microbiol. Biotechnol.* 41(1):39-46). Exemplary chondroitinase AC enzymes from the bacteria include, but are not limited to, those from *Flavobacterium heparinum*, set forth in SEQ ID NO:99, *Victivallis vadensis*, set forth in SEQ ID NO:100, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2):121-4; Michelacci et al. (1976) *J. Biol. Chem.* 251:1154-8; Tsuda et al. (1999) *Eur. J. Biochem.* 262:127-133).

As used herein, hyaluronidase refers to a class of hyaluronan degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS:10, 11, 64 and BH55 (U.S. Pat. Nos. 5,747,027 and 5,827,721)), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), sheep (SEQ ID NOS:26, 27, 63 and 65), chimpanzee (SEQ ID NO:101), Rhesus monkey (SEQ ID NO:102), orangutan (SEQ ID NO:28), cynomolgus monkey (SEQ ID NO:29), guinea pig (SEQ ID NO:30), Arthrobacter sp. (strain FB24) (SEQ ID NO:67), *Bellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); and serotype III (SEQ ID NO:73)), *Staphylococcus aureus* (strain COL (SEQ ID NO:74); strain MRSA252(SEQ ID NOS:75 and 76); strain MSSA476 (SEQ ID NO:77); strain NCTC 8325(SEQ ID NO:78); strain bovine RF122 (SEQ ID NOS:79 and 80); and strain USA300 (SEQ ID NO:81)), *Streptococcus pneumoniae* ((SEQ ID NO:82); strain ATCC BAA-255 / R6 (SEQ ID NO:83); and serotype 2, strain D39 / NCTC 7466 (SEQ ID NO:84)), *Streptococcus pyogenes* (serotype M1 (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); and serotype M28 (SEQ ID NO:92)); *Streptococcus suis* (SEQ ID NOS:93-95); *Vibrio fischeri* (strain ATCC 700601/ ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases also include those of human origin. Exemplary human hyaluronidases include HYAL1 (SEQ ID NO:36), HYAL2 (SEQ ID NO:37), HYAL3 (SEQ ID NO:38), HYAL4 (SEQ ID NO:39), and PH20 (SEQ ID NO:1). Also included amongst hyaluronidases are soluble hyaluronidases, including, ovine and bovine PH20, soluble human PH20 and soluble rHuPH20. Examples of commercially available bovine or ovine soluble hyaluronidases include Vitrase® (ovine hyaluronidase), Amphadase® (bovine hyaluronidase) and Hydase® (bovine hyaluronidase).

As used herein, "purified bovine testicular hyaluronidase" refers to a bovine hyaluronidase purified from bovine testicular extracts (see U.S. Pat. Nos. 2,488,564, 2,488,565, 2,806,815, 2,808,362, 2,676,139, 2,795,529, 5,747,027 and 5,827,721). Examples of commercially available purified bovine testicular hyaluronidases include Amphadase® and Hydase™, and bovine hyaluronidases, including, but not limited to, those available from Sigma Aldrich, Abnova, EMD Chemicals, GenWay Biotech, Inc., Raybiotech, Inc., and Calzyme. Also included are recombinantly produced bovine hyaluronidases, such as but not limited to, those generated by expression of a nucleic acid molecule set forth in any of SEQ ID NOS:190-192.

As used herein, "purified ovine testicular hyaluronidase" refers to an ovine hyaluronidase purified from ovine testicular extracts (see U.S. Pat. Nos. 2,488,564, 2,488,565 and 2,806,815 and International PCT Publication No. WO2005/118799). Examples of commercially available purified ovine testicular extract include Vitrase®, and ovine hyaluronidases, including, but not limited to, those available from Sigma Aldrich, Cell Sciences, EMD Chemicals, GenWay Biotech, Inc., Mybiosource.com and Raybiotech, Inc. Also included are recombinantly produced ovine hyaluronidases, such as, but not limited to, those generated by expression of a nucleic acid molecule set forth in any of SEQ ID NOS:66 and 193-194.

As used herein, "PH20" refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides include those from human (SEQ ID NO:1), chimpanzee (SEQ ID NO:101), Rhesus monkey (SEQ ID NO:102), Cynomolgus monkey (SEQ ID NO:29), cow (e.g., SEQ ID NOS:11 and 64), mouse (SEQ ID NO:32), rat (SEQ ID NO:31), rabbit (SEQ ID NO:25), sheep (SEQ ID NOS:27, 63 and 65) and guinea pig (SEQ ID NO:30).

Reference to hyaluronan degrading enzymes includes precursor hyaluronan degrading enzyme polypeptides and mature hyaluronan degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NOS: 1 and 10-48, 63-65, 67-102, or the mature forms thereof. For example, reference to hyaluronan degrading enzyme also includes the human PH20 precursor polypeptide variants set forth in SEQ ID NOS:50-51. Hyaluronan degrading enzymes also include those that contain chemical or post-translational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, a "soluble PH20" refers to any form of PH20 that is soluble under physiologic conditions. A soluble PH20 can be identified, for example, by its partitioning into the aqueous phase of a Triton® X-114 solution at 37° C. (Bordier et al., (1981) J. Biol. Chem., 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also includes recombinant soluble PH20 and those contained in or purified from natural sources, such as, for example, testes extracts from sheep or cows. Exemplary of such soluble PH20 is soluble human PH20.

As used herein, soluble human PH20 or sHuPH20 includes PH20 polypeptides lacking all or a portion of the glycosylphosphatidylinositol (GPI) anchor sequence at the C-terminus such that upon expression, the polypeptides are soluble under physiological conditions. Solubility can be assessed by any suitable method that demonstrates solubility under physiologic conditions. Exemplary of such methods is the Triton® X-114 assay, that assesses partitioning into the aqueous phase and that is described above and in the examples. In addition, a soluble human PH20 polypeptide is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion by CHO cells is definitional. Hence, if a polypeptide could be expressed and secreted by CHO cells and is soluble, i.e. partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e. native) signal sequence. Exemplary of the precursors are those that include a signal sequence, such as the native 35 amino acid signal sequence at amino acid positions 1-35 (see, e.g., amino acids 1-35 of SEQ ID NO:1).

As used herein, an "extended soluble PH20" or "esPH20" includes soluble PH20 polypeptides that contain residues up to the GPI anchor-attachment signal sequence and one or more contiguous residues from the GPI-anchor attachment signal sequence such that the esPH20is soluble under physiological conditions. Solubility under physiological conditions can be determined by any method known to those of skill in the art. For example, it can be assessed by the Triton® X-114 assay described above and in the examples. In addition, as discussed above, a soluble PH20 is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion by CHO cells is definitional. Hence, if a polypeptide could be expressed and secreted by CHO cells and is soluble, i.e. partitions into the aqueous phase when extracted with Triton® X-114, it is a soluble PH20 polypeptide whether or not it is so-produced. Human soluble esPH20 polypeptides include, in addition to residues 36-490, one or more contiguous amino acids from amino acid residue position 491 of SEQ ID NO:1, inclusive, such that the resulting polypeptide is soluble. Exemplary human esPH20 soluble polypeptides are those that have amino acids residues corresponding to amino acids 36-491, 36-492, 36-493, 36-494, 36-495, 36-496 and 36-497 of SEQ ID NO:1. Exemplary of these are those with an amino acid sequence set forth in any of SEQ.ID NOS:151-154 and 185-187. Also included are allelic variants and other variants, such as any with 40%, 45%, 50%,55%, 65%, 70%, 75%, 80%, 85%, 90%, 91%, 92%, 93%, 94%, 95%, 96%, 97%, 98%, 99% or greater sequence identity with the corresponding polypeptides of SEQ ID NOS:151-154 and 185-187 that retain neutral activity and are soluble. Reference to sequence identity refers to variants with amino acid substitutions.

As used herein, reference to "esPH20s" includes precursor esPH20 polypeptides and mature esPH20 polypeptides (such as those in which a signal sequence has been removed), truncated forms thereof that have enzymatic activity (retaining at least 1%, 10%, 20%, 30%, 40%, 50% or more of the full-length form) and are soluble, and includes allelic variants and species variants, variants encoded by splice variants, and other variants, including polypeptides that have at least 40%, 45%, 50%, 55%, 65%, 70%, 75%, 80%, 85%, 90%, 91%, 92%, 93%, 94%, 95%, 96%, 97%, 98%, 99% or more sequence identity to the precursor polypeptides set forth in SEQ ID NOS:1 and 3, or the mature forms thereof.

As used herein, reference to "esPH20s" also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art.

As used herein, "soluble recombinant human PH20 (rHuPH20)" refers to a composition containing solubles form of human PH20 as recombinantly expressed and secreted in Chinese Hamster Ovary (CHO) cells. Soluble rHuPH20 is encoded by nucleic acid molecule that includes the signal sequence and is set forth in SEQ ID NO:49. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NO:4 to SEQ ID NO:9 in various abundance.

Similarly, for other forms of PH20, such as the esPH20s, recombinantly expressed polypeptides and compositions thereof can include a plurality of species whose C-terminus exhibits heterogeneity. For example, compositions of recombinantly expressed esPH20 produced by expression of the polypeptide of SEQ ID NO:151, which encodes an esPH20 that has amino acids 36-497, can include forms with fewer amino acids, such as 36-496 or 36-495.

As used herein, an "N-linked moiety" refers to an asparagine (N) amino acid residue of a polypeptide that is capable of being glycosylated by post-translational modification of a polypeptide. Exemplary N-linked moieties of human PH20 include amino acids N82, N166, N235, N254, N368 and N393 of human PH20 set forth in SEQ ID NO:1.

As used herein, an "N-glycosylated polypeptide" refers to a PH20 polypeptide or truncated form thereto containing oligosaccharide linkage of at least three N-linked amino acid residues, for example, N-linked moieties corresponding to amino acid residues N235, N368 and N393 of SEQ ID NO:1. An N-glycosylated polypeptide can include a polypeptide where three, four, five and up to all of the N-linked moieties are linked to an oligosaccharide. The N-linked oligosaccharides can include oligomannose, complex, hybrid or sulfated oligosaccharides, or other oligosaccharides and monosaccharides.

As used herein, an "N-partially glycosylated polypeptide" refers to a polypeptide that minimally contains an N-acetylglucosamine glycan linked to at least three N-linked moieties. A partially glycosylated polypeptide can include various glycan forms, including monosaccharides, oligosaccharides, and branched sugar forms, including those formed by treatment of a polypeptide with EndoH, EndoF1, EndoF2 and/or EndoF3.

As used herein, a "deglycosylated PH20 polypeptide" refers to a PH20 polypeptide in which fewer than all possible glycosylation sites are glycosylated. Deglycosylation can be effected, for example, by removing glycosylation, by preventing it, or by modifying the polypeptide to eliminate a glycosylation site. Particular N-glycosylation sites are not required for activity, whereas others are.

As used herein, a "polymer" refers to any high molecular weight natural or synthetic moiety that is made up of repeating unites. Polymers include, but are not limited to, polyethylene glycol moieties, dextran, cellulose and sialic acid. These and other exemplary polymers are described herein, and many are known in the art. For purposes herein, the polymer can be conjugated to, i.e. stably linked directly or indirectly via a linker, to a polypeptide. Such polymer conjugates, typically increase serum half-life, and include, but are not limited to sialic moieties, PEGylation moieties, dextran, and sugar and other moieties, such as glycosylation. For example, hyaluronidases, such as a soluble PH20 or rHuPH20, can be conjugated to a polymer As used herein, "PEGylated" refers to covalent or other stable attachment of polymeric molecules, such as polyethylene glycol (PEGylation moiety PEG) to proteins, including hyaluronan degrading enzymes, such as hyaluronidases, typically to increase half-life of the hyaluronan degrading enzyme.

As used herein, an anti-cancer agent or chemotherapeutic agent refers to an agent that is capable of killing cells that divide rapidly, such as cancer cells. One of skill in the art is familiar with anti-cancer agents, including chemotherapeutic agents. Exemplary agents are described herein.

As used herein, a nucleoside analog (or analogue) refers to an agent that replaces or mimics one of the building blocks of nucleic acids, such as a purine or pyrimidine nucleoside, during DNA replication. The process can arrest tumor growth, since additional nucleosides cannot attach. Exemplary of a nucleoside analog is gemcitabine, which, is a deoxycytidine analog and upon metabolic activation, forms a triphosphate that mimics or replaces the nucleoside cytidine to incorporate into DNA and competitively inhibit DNA synthesis.

As used herein, a nucleoside deaminase refers to an enzyme that effects deamination of a nucleoside. For example, cytidine deaminase (CDA) deaminates cytidine and deoxycytidine to uridine and deoxyuridine, respectively. Adenosine deaminase (ADA) deaminates adenosine, converting it to the related nucleoside inosine by the substitution of the amino group for a hydroxyl group.

As used herein, a substrate of a nucleoside deaminase is a molecule that can be deaminated to an inactive metabolite, and hence inactivated, in the presence of a nucleoside deaminase. Assays to assess deamination are known to one of skill in the art, and include, but are not limited to, high performance liquid chromatography (HPLC) or mass spectrometry for metabolites and deaminated metabolites, a deamination assays such as a UDG-based deaminase assay using excess uracil-DNA glycosylase (see e.g. Morgan et al. (2004) J. Biol. Chem., 279:52353-52360) or by assessing cytotoxicity in cells known to express a nucleoside deaminase.

As used herein, the phrase "sufficient to reduce nucleoside deaminase protein levels or protein activity" refers to the amount of taxane that is required in order to inhibit the activity of a nucleoside deaminase. For example, the inhibition can be assessed by assaying the deamination activity of a deaminase (e.g. cytidine deaminase) using assays for deamination as described above. The inhibition also can be assessed by assaying for intracellular deaminase protein levels. Assays to assess subcellular proteins are well-known to one of skill in the art and include for example, cell-based ELISA, flow cytometry or protein detection methods such as Western blot. Generally, such assays can be performed on cell lysates or permeabilized cells. For example, western blot for cytidine deaminase can be performed by solubilizing total cell lysates, separating proteins, and immunoblotting for deaminase using an antibody against CDA (e.g. Cat. No. ab82346, Abcam) followed by incubation with a secondary horseradish peroxidase antibody, and detection. Generally, an amount is sufficient to reduce nucleoside deaminase protein levels or protein activity if the protein level or activity is reduced at least or at least about 10%, 20%, 30%, 40%, 50%, 60%, 70%, 80%, 90% or more.

As used herein, a prodrug is a compound which exhibits pharmacologic activity after biotransformation. For example, nucleoside analogs such as gemcitabine are prodrugs, whereby activity occurs as a result of intracellular conversion to two active metabolites, gemcitabine diphosphate and gemcitabine triphosphate by deoxycytidine kinase. The triphosphate (difluororodeoxycytidine triphosphate) competes with endogenous deoxynucleoside triphosphates for incorporation into DNA.

As used herein, a derivative refers to a form of a drug that has undergone change or modification from a reference drug or agent, but still retains activity (e.g. exhibits increased or decreased activity) compared to the reference drug or agent. Typically a derivative form of a compound means that a side chain of the compound has been modified or changed.

As used herein, an analogue or analog of a drug or agent is a drug or agent that is related to a reference drug, but whose chemical and biological activities can be different. Typically, analogues exhibit similar activities to a reference drug or agent, but the activity can be increased or decreased or otherwise improved. Typically, an analogue form of a compound or drug means that the backbone core of the structure is modified or changed compared to a reference drug.

As used herein, "activity" refers to a functional activity or activities of a polypeptide or portion thereof associated with a full-length (complete) protein. For example, active fragments of a polypeptide can exhibit an activity of a full-length protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, "hyaluronidase activity" refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as PH20, including soluble PH20 and esPH20, are known in the art and described herein. Exemplary assays include the microturbidity assay that measures cleavage of hyaluronic acid by hyaluronidase indirectly by detecting the insoluble precipitate formed when the uncleaved hyaluronic acid binds with serum albumin and the biotinylated-hyaluronic acid assay that measures the cleavage of hyaluronic acid indirectly by detecting the remaining biotinylated-hyaluronic acid non-covalently bound to microtiter plate wells with a streptavidin-horseradish peroxidase conjugate and a chromogenic substrate. Reference Standards can be used, for example, to generate a standard curve to determine the activity in Units of the hyaluronidase being tested.

As used herein, specific activity refers to Units of activity per mg protein. The milligrams of hyaluronidase is defined by the absorption of a solution of at 280 nm assuming a molar extinction coefficient of approximately 1.7, in units of $M^{-1} cm^{-1}$.

As used herein, "neutral active" refers to the ability of a PH20 polypeptide to enzymatically catalyze the cleavage of hyaluronic acid at neutral pH (e.g. at or about pH 7.0).

As used herein, a "GPI-anchor attachment signal sequence" is a C-terminal sequence of amino acids that directs addition of a preformed GPI-anchor to the polypeptide within the lumen of the ER. GPI-anchor attachment signal sequences are present in the precursor polypeptides of GPI-anchored polypeptides, such as GPI-anchored PH20 polypeptides. The C-terminal GPI-anchor attachment signal sequence typically contains a predominantly hydrophobic region of 8-20 amino acids, preceded by a hydrophilic spacer region of 8-12 amino acids, immediately downstream of the w-site, or site of GPI-anchor attachment. GPI-anchor attachment signal sequences can be identified using methods well known in the art. These include, but are not limited to, in silico methods and algorithms (see, e.g. Udenfriend et al. (1995) *Methods Enzymol.* 250:571-582, Eisenhaber et al., (1999) *J. Biol. Chem.* 292: 741-758, Fankhauser et al., (2005) *Bioinformatics* 21:1846-1852, Omaetxebarria et al., (2007) *Proteomics* 7:1951-1960, Pierleoni et al., (2008) BMC Bioinformatics 9:392), including those that are readily available on bioinformatic websites, such as the ExPASy Proteomics tools site (e.g., the World Wide Web site expasy.ch/tools/).

As used herein, "nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to 2 amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH.

As used herein, the "naturally occurring α-amino acids" are the residues of those 20 α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-stereoisomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g. Computational Molecular Biology, Lesk, A.M., ed., Oxford University Press, New York, 1988; Biocomputing: Informatics and Genome Projects, Smith, D.W., ed., Academic Press, New York, 1993; Computer Analysis of Sequence Data, Part I, Griffin, A.M., and Griffin, H.G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well:known to skilled artisans (Carrillo, H. & Lipman, D., SIAM J Applied Math 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; Carrillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I):387 (1984)), BLASTP, BLASTN, FASTA (Altschul, S. F., et al., *J Mol Biol* 215:403 (1990)); Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman ((1981) Adv. Appl. Math. 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art.

The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90%, 95% or greater identity with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human. For example for PH20, exemplary of species variants provided herein are primate PH20, such as, but not limited to, human, chimpanzee, macaque and cynomolgus monkey. Generally, species variants have 70%, 75%, 80%, 85%, 90%, 91%, 92%, 93%, 94%, 95%, 96%, 97%, 98% or more sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to or greater than 99%. The position of interest is then given the number assigned in the reference nucleic acid molecule. Alignment can be effected manually or by eye, particularly, where sequence identity is greater than 80%.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements (e.g. substitutions) of amino acids and nucleotides, respectively. Exemplary of modifications are amino acid substitutions. An amino-acid substituted polypeptide can exhibit 65%, 70%, 80%, 85%, 90%, 91%, 92%, 93%, 94%, 95%, 96%, 97%, 98% or more sequence identity to a polypeptide not containing the amino acid substitutions. Amino acid substitutions can be conservative or non-conservative. Generally, any modification to a polypeptide retains an activity of the polypeptide. Methods of modifying a polypeptide are routine to those of skill in the art, such as by using recombinant DNA methodologies.

As used herein, suitable conservative substitutions of amino acids are known to those of skill in the art and can be made generally without altering the biological activity of the resulting molecule. Those of skill in the art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p.224). Such substitutions can be made in accordance with those set forth in Table 2 as follows:

TABLE 2

| Original residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile;Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified soluble PH20, refers to preparations of proteins that are substantially free of cellular material includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as a contaminating protein), generally less than about 20% of non-enzyme proteins or 10% of non-enzyme proteins or less than about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein the term "assessing" is intended to include quantitative and qualitative determination in the sense of obtaining an absolute value for the activity of a protein, such as an enzyme, or a domain thereof, present in the sample, and also of obtaining an index, ratio, percentage, visual or other value indicative of the level of the activity. Assessment can be direct or indirect. For example, the chemical species actually detected need not of course be the enzymatically cleaved product itself but can for example be a derivative thereof or some further substance. For example, detection of a cleavage product can be a detectable moiety such as a fluorescent moiety.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a hyaluronidase enzyme is its degradation of hyaluronic acid.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, direct administration refers to a composition that is administered without dilution.

As used herein, a single dosage formulation refers to a formulation for use only once. Typically, a single dosage formulation is for direct administration.

As used herein, a multiple dosage formulation refers to a formulation for use in repeat administrations.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are hyaluronan-associated diseases and disorders.

As used herein, "intravenous administration" refers to delivery of a therapeutic directly into a vein.

As used herein, a "hyaluronan-associated cancer" or "hyaluronan rich cancers" include cancers in which hyaluronan levels are elevated as cause, consequence or otherwise observed in the disease or condition. Hyaluronan-associated cancers or tumors are associated with elevated hyaluronan levels in a tissue or cell, increased interstitial fluid pressure, decreased vascular volume, and/or increased water content in a tissue. Such cancers include, for example, tumors, including solid tumors such as late-stage cancers, metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers.

As used herein, elevated hyaluronan levels refers to amounts of hyaluronan in particular tissue, body fluid or cell, dependent upon the disease or condition, consequence or otherwise observed in the disease. For example, as a consequence of the presence of a hyaluronan-rich tumor, hyaluronan (HA) levels can be elevated in body fluids, such as blood, urine, saliva and serum, and/or in the tumorous tissue or cell. The level can be compared to a standard or other suitable control, such as a comparable sample from a subject who does not have the HA-associated disease.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease.

As used herein, a pharmaceutically effective agent, includes any therapeutic agent or bioactive agents, including, but not limited to, for example, chemotherapeutics, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject exhibiting symptoms of a disease or disorder.

As used herein, about the same means within an amount that one of skill in the art would consider to be the same or to be within an acceptable range of error. For example, typically, for pharmaceutical compositions, within at least 1%, 2%, 3%, 4%, 5% or 10% is considered about the same. Such amount can vary depending upon the tolerance for variation in the particular composition by subjects.

As used herein, dosing regime refers to the amount of agent, for example, the composition containing an anti-hyaluronan agent, for example a soluble hyaluronidase or other agent, administered, and the frequency of administration. The dosing regime is a function of the disease or condition to be treated, and thus can vary.

As used herein, frequency of administration refers to the time between successive administrations of treatment. For example, frequency can be days, weeks or months. For example, frequency can be more than once weekly, for example, twice a week, three times a week, four times a week, five times a week, six times a week or daily. Frequency also can be one, two, three or four weeks. The particular frequency is function of the particular disease or condition treated. Generally, frequency is more than once weekly, and generally is twice weekly.

As used herein, a "cycle of administration" refers to the repeated schedule of the dosing regime of administration of the enzyme and/or a second agent that is repeated over successive administrations. For example, an exemplary cycle of administration is a 28 day cycle with administration twice weekly for three weeks, followed by one-week of discontinued dosing.

As used herein, when referencing dosage based on mg/kg of the subject, an average human subject is considered to have a mass of about 70 kg-75 kg, such as 70 kg and a body surface area (BSA) of 1.73.

As used herein, amelioration of the symptoms of a particular disease or disorder by a treatment, such as by administration of a pharmaceutical composition or other therapeutic, refers to any lessening, whether permanent or temporary, lasting or transient, of the symptoms or, adverse effects of a condition, such as, for example, reduction of adverse effects associated with or that occur upon administration of an anti-hyaluronan agent, such as a PEGylated hyaluronidase.

As used herein, prevention or prophylaxis refers to reduction in the risk of developing a disease or condition.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation as a single dose.

As used herein, formulation for direct administration means that the composition does not require further dilution for administration.

As used herein, an "article of manufacture" is a product that is made and sold.

As used throughout this application, the term is intended to encompass anti-hyaluronan agents, for example hyaluronan degrading enzyme, such as hyaluronidase, and second agent compositions contained in articles of packaging. For example, a second agent is a corticosteroid, tumor-targeted taxane or chemotherapeutic agent.

As used herein, fluid refers to any composition that can flow. Fluids thus encompass compositions that are in the form of semi-solids, pastes, solutions, aqueous mixtures, gels, lotions, creams and other such compositions.

As used herein, a combination, such as a combination of compositions provided herein, refers to an association of elements of the combination.

As used herein a kit refers to a combination of components, such as a combination of the compositions herein and another item for a purpose including, but not limited to, reconstitution, activation, and instruments/devices for delivery, administration, diagnosis, and assessment of a biological activity or property. Kits optionally include instructions for use.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The hyaluronidases provided herein are from any source, animal, plant, prokaryotic and fungal. Most hyaluronidases are of animal origin, including mammalian origin. Generally hyaluronidases are of human origin.

As used herein, anti-cancer treatments include administration of drugs and other agents for treating cancer, and also treatment protocols, such as surgery and radiation. Anti-cancer treatments include administration of anti-cancer agents.

As used herein, an anti-cancer agent refers to any agents, or compounds, used in anti-cancer treatment. These include any agents, when used alone or in combination with other compounds, that can alleviate, reduce, ameliorate, prevent, or place or maintain in a state of remission of clinical symptoms or diagnostic markers associated with tumors and cancer, and can be used in combinations and compositions provided herein. Exemplary anti-cancer agents include, but are not limited to, hyaluronan-degrading enzymes, such as the PEGylated hyaluronan degrading enzymes provided herein used singly or in combination with other anti-cancer agents, such as chemotherapeutics, polypeptides, antibodies, peptides, small molecules or gene therapy vectors, viruses or DNA.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound comprising or containing "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Anti-Hyaluronan Agent Combination Therapy

Provided herein are combination therapies of an anti-hyaluronan agent, such as a hyaluronan-degrading enzyme, and a tumor targeted-taxane, such as albumin-bound paclitaxel, for use in the treatment of cancers. For example, provided herein are combination therapies of polymer-conjugated hyaluronan-degrading enzyme, for example a hyaluronidase, such as PEGPH20, and a tumor targeted-taxane, such as albumin-bound paclitaxel, for use in the treatment of cancers. In particular, the combination therapy provided herein is used in the treatment of any cancers characterized by solid tumors that are impenetrable because of the stromal layer. Exemplary of such cancers include solid tumor cancers, such as but not limited to, pancreatic cancer, breast cancer, prostate cancer, gastric cancer, colon cancer, ovarian cancer, head and neck cancer and others. The combination therapy can further include a further cytotoxic chemotherapeutic drug, for example any whose activity is increased (e.g. due to increased delivery and/or increased half-life) by one or both of the anti-hyaluronan agent, for example, the polymer-conjugated hyaluronan-degrading enzyme, and/or tumor-targeted taxane. For example, the further chemotherapeutic agent can be a nucleoside analog, such as gemcitabine or a derivative thereof, that exhibits direct anti-tumor activities.

1. Solid Tumors and Tumor Targeted Therapies

Solid tumors are made up of cancer cells and stroma cells (e.g. fibroblasts and inflammatory cells) that are surrounded by an extracellular matrix and vascular network. The stromal cells, extracellular matrix components and/or vasculature generally are abnormal compared to those present in normal tissues. For example, many solid tumors have an increased number of fibroblasts compared to normal tissues. Also, the vasculature in solid tumors can exhibit a branched or convoluted structure compared to normal vasculature, and exhibit structural aberrations characterized by dilated vessels, reduction in endothelial lining and/or compressed vessels. Finally, the tumor and stromal cells produce and assemble a complex network of extracellular matrix components, such as collagens, proteoglycans, glycosaminoglycans (e.g. hyaluronan) and other molecules that form a dense mass and can contribute to high tumor interstitial pressure. The high interstitial fluid pressure above the intravascular pressure in the terminal arterioles and capillaries can impair perfusion of fluids and solutes into the interstitium. Thus, the high interstitial pressure can hamper uptake of therapeutics into tumor tissues, and also can affect the growth properties of tumor cells to support tumor cell proliferation.

For tumor therapies to be effective, the drugs must efficiently exit the tumor blood vessels and penetrate tumor tissues to reach cancer cells. The high interstitial fluid pressure as well as the dense composition and organization of the extracellular matrix and associated cells affect drug penetration. The result is that the stromal barrier often prevents the penetration of antitumor drugs into the tumors, which renders many conventional cancer treatments ineffective.

For example, pancreatic cancer is among the most impenetrable of all solid tumor cancers. As a result, pancreatic cancers, including pancreatic ductal adenocarcinoma, are characterized by an innate resistance to conventional chemotherapeutics such that the 5-year survival rate is less than 5%. The standard therapy for pancreatic cancer is treatment with gemcitabine. Gemcitabine has limited effects on increasing patient survival. For example, only about a quarter of patients treated with gemcitabine monotherapy exhibit a clinical benefit with median survival of just over 5 months, which was only one month longer than treatment with the chemotherapeutic agent fluorouracil (5-FU) (Burris et al. (1997) *J Clin Oncol,* 15:2403-2413). In an adjuvant setting where treatment is also accompanied by pancreatic cancer surgery or other non-chemotherapeutic adjuvant therapy, gemcitabine increased survival by two months compared to patients who had surgery alone (Neuhaus et al. (2008) *J. Clin. Oncol.* 26: May 20 suppl; abst.).

Recently, therapies have been developed that include a therapeutic agent that can penetrate the stromal layer and associated vasculature. Therapeutics that can deplete the stroma, punch holes in or otherwise penetrate the stroma are viewed as promising therapeutics for many cancers characterized by an impenetrable stromal layer. Such agents include, for example, albumin-conjugated taxanes (Von Hoff et al. (2011) *J. Clin. Oncol.,* 29:4548-54; Frese et al. (2012) *Cancer Discovery,* 2:260-269), a hedgehog inhibitor (Olive et al. (2009) *Science,* 324:1457-61) and polymer-conjugated hyaluronidase (Provenzano et al. (2012) *Cancer Cell,* 21:418-429). Each of these treatments is also associated with increased delivery of non-stromal targeted chemotherapeutic agents, resulting in enhanced antitumor effects and a doubling of survival time compared to chemotherapeutic agent (e.g. gemcitabine) monotherapy.

a. Tumor-Targeted Taxane

Taxanes, such as paclitaxel (e.g. Taxol®) and docetaxel (e.g. Taxotere®) are potent chemotherapeutic agents for use in the treatment of multiple tumor types. Taxanes act as mitotic inhibitors by binding with high-affinity to microtubules, thereby interfering with cell division. The result is that taxanes prevent tumor cell growth and metastasis, and can cause cell death. Therapeutic use of taxanes has been limited due to problems with solubility and associated toxicities, long-term systemic availability and inaccessibility to the tumor stroma.

To overcome problems associated with the therapeutic use of taxanes, gp60 receptor targeted nanoparticle drug formulation have been developed made up of an albumin-bound particle forms of taxanes. These include, for example, nanoparticle albumin-bound (nab)-paclitaxel (ABI-007, e.g. Abraxane®) and nanoparticle albumin-bound docetaxel (ABI-008). Gp60 is the albumin receptor on vascular endothelium. Albumin receptor-mediated uptake via gp60 results in the association with intracellular caveolin-1 leading to invagination of the cell membrane to form transcytotic vesicles (termed caveolae) containing the bound plasma constituents from the extracellular space, transcytosis and extravascular deposition of the caveolae contents. In addition, albumin also binds to SPARC (secreted protein acid and rich in cysteine), which is an extracellular matrix glycoprotein that is overexpressed and associated with poor prognosis in a variety of cancers. The result is that stromal barriers to drug delivery are circumvented, and a higher intratumoral concentration of the drug is achieved. Nab-Paclitaxel can achieve higher intratumoral concentrations and increased bioavailability compared to conventional solvent-based paclitaxel (Foote (2007) *Biotechnology Annual Review,* 13:345).

Since tumor-targeted taxanes, such as albumin-conjugated taxanes, are able to penetrate and deplete or collapse the stroma, these agents can be used in combination with other non-stromal targeted chemotherapeutic agents in order to enhance delivery of the other agents to the tumor. The mechanism for enhanced delivery is attributed to disruption of the stromal architecture and induction of reactive angiogenesis that leads to increased perfusion and delivery of the chemotherapeutic agent (see, e.g., Frese et al. (2012) *Cancer Discovery,* 2:260-269). For example studies have shown that nab-paclitaxel, an albumin-conjugated taxane, in combination with gemcitabine enhanced by almost 2.8 times the amount of gemcitabine in the tumor compared to treatment with gemcitabine alone (Von Hoff et al. (2011) *J. Clin. Oncol.,* 29:4548-4554). The results also showed that the combination therapy doubled survival time of patients with pancreatic cancer (Von Hoff et al. (2011)).

The mechanism for enhanced intratumoral amounts of gemcitabine in combination with nab-paclitaxel therapy has more recently been attributed to an independent mechanism related to a reduction in cytidine deaminase (Cda) in nab-paclitaxel treated groups (Frese et al. (2012) *Cancer Discovery* 2:260-269). Cda is ubiquitously expressed in cells, and can inactivate gemcitabine by deamination into its metabolite difluorodeoxyuridine (dFdU). The nab-paclitaxel treatment increased reactive oxygen species (ROS), which led to the degradation of Cda without any modulation of mRNA levels. Hence, co-treatment with nab-paclitaxel results in a reduction in the deamination of gemcitabine, and thereby stabilizes gemcitabine leading to an elevation of intratumoral gemcitabine levels.

b. Anti-Hyaluronan Agent

Anti-hyaluronan agents reduce hyaluronic acid (HA; also referred to herein as hyaluronan) levels by interfering with its synthesis or increasing its degradation. For example, hyaluronan-degrading enzymes, such as hyaluronidase enzymes, are enzymes that interfere with and degrade hyaluronic acid. Hyaluronan is a major component of the extracellular matrix of solid tumors. HA is a high molecular weight linear glycosaminoglycan that contains repeating disaccharide units, $\beta$-1,3 N-acetyl-D-glucosamine-linked $\beta$-1,4 to D-glucuronic acid. HA occurs naturally in the body and is secreted at extremely high levels in some cancer cells, including pancreatic cancer cells. Local aberrations of HA metabolism have been reported in many solid tumor malignancies, where elevated levels of HA frequently correlate with poor prognosis in tumors such as breast, gastric, colorectal, ovarian, prostate and lung carcinoma.

HA is involved in increased water uptake and interstitial fluid pressure (IFP) in disease tissues, such as tumors, thereby resulting in compressed tumor vasculature. For example, at sites of inflammation or in a tumor focus, there is rapid accumulation of hyaluronan, other matrix components and water. Because of this rapid accumulation, the diseased site cannot come to equilibrium with its environment and therefore has a higher interstitial fluid pressure than normal tissues. As discussed above, the IFP of most solid tumors and other diseased tissues associated with accumulated HA is elevated, acting as a barrier to efficient drug delivery (Heldin et al. (2004) *Nat Rev Cancer* 4(10): 806-813). HA accumulation also reduces contact inhibition between and among tumor cells (see, e.g., Itano et al. (2002) *Proc. Natl. Acad. Sci. U.S.A.* 99:3609-3614).

Anti-hyaluronan agents that inhibit HA synthesis or degrade hyaluronan, such as hyaluronan-degrading enzymes, e.g., hyaluronidases (e.g. PH20), can reduce hyaluronan such that the tissue deflates, the blood vessels expand, and more blood can flow through the site. This results in a diminishment of the interstitial fluid pressure at the tissue site and an associated increase in vascular perfusion. For example, hyaluronidase has been shown to remove HA from tumors resulting in the reduction of tumor volume, the reduction of intratumoral interstitial pressure, the slowing of tumor cell proliferation, and the enhanced efficacy of co-administered chemotherapeutic drugs and biological agents by enabling increased tumor penetration (see e.g. U.S. published application No. 20100003238 and International published PCT Appl. No WO 2009/128917).

The use of hyaluronidase, such as a PH20 enzyme, for systemic treatment suffers from problems associated with short half-life of the enzyme. For example, unmodified hyaluronidase typically has a short half-life of enzymatic activity in blood of minutes, generally less than 5 mintues. This means that such enzymes are generally unsuitable for use in intravenous administrations, and other administrations, where their duration of action is short-lived. This is because following degradation, the HA substrate is replaced with a half-life of approximately 5 h. In contrast, methods that increase the delivery and/or prolong the association of a hyaluronidase with cell-associated hyalurounan (e.g. tumor-associated pericellular hyaluronan) allows for treatment of tumors rich in HA. Such methods can include, but are not limited to, conjuation of the enzyme to a polymer, the use of an enzyme that is aglycosylated or that is modifed to have reduced glycosyaltion, continuous infusion of the enzyme and/or localized delivery of the enzyme. For example, polymer-modification of hyaluronidase, such as by PEGylation, increases the half-life of the enzyme to approximately 48 to 72 hours and allows for the systemic treatment of tumors rich in HA (see e.g. U.S. published application No. 20100003238 and International published PCT Appl. No. WO 2009/128917). The increased half-life relative to unmodified hyaluronidase permits continued removal of HA, and thereby reduces or decreases the extent of regeneration of HA within diseased tissues, such as the tumor. Thus, maintenance of plasma enzyme levels by polymer conjugation can remove HA, such as tumor HA, and also counteract HA resynthesis.

In addition, polymer-conjugated hyaluronan-degrading enzymes, such as a polymer-conjugated hyaluronidase or PH20, for example PEGPH20, can deplete the stroma surrounding cancer cells by degrading HA. Such agents can be used in single agent therapy for the treatment of tumors or in combination therapy to enhance the delivery of non-stromal targeted chemotherapeutic agents such as gemcitabine. Results from clinical trials of patients with pancreatic cancer also show that PEGPH20 treatment in combination with gemcitabine results in a near doubling of overall survival compared to treatment with gemcitabine alone (Provenzano et al. (2012) *Cancer Cell,* 21:418-429).

2. Anti-Hyaluronan Agent and Tumor-Targeted Taxane Combination Therapy

It is found herein that combination therapies containing at least two different stromal or tumor targeted therapies exhibit efficacy that is far greater than a single stromal targeting agent. For example, it is found herein that combination therapy with tumor-targeted taxanes and an anti-hyaluronan agent, in particular an anti-hyaluronan agent capable of reaching pericellular HA on a tumor for a time sufficient to reduce HA levels, exhibits increased efficacy compared to the single treatment of either agent alone. For example, combination therapy with a tumor-targeted taxane and a polymer-conjugated hyaluronidase results in an increase in efficacy of greater than 25% compared to the single agent treatment. In further combination with the non-stromal targeted chemotherapeutic drug gemcitabine, the median survival of an exemplary cancer was increased by 79% in a mouse model of pancreatic cancer compared to treatment with only gemcitabine and was increased by over 30% compared to existing therapies containing only a single stromal targeting agent. This increase in efficacy can be translated to a substantial improvement in the survival of patients with pancreatic cancer and other cancers characterized by an impenetrable stroma compared to existing treatments.

Hence, provided herein are methods using a combination therapy containing a anti-hyaluronan agent, such as a hyaluronan-degrading enzyme or polymer-conjugated hyaluronan-degrading enzyme (e.g. hyaluronidase or PH20), and a tumor-targeted taxane, such as an albumin bound-taxane, for treating solid tumor stromal cancers. For example, the combination therapy can be used for the treatment of pancreatic cancer, breast cancer, prostate cancer, gastric cancer, colon cancer, colorectal cancer, lung cancer, ovarian cancer and others. The compositions containing the anti-hyaluronan agent, such as polymer-conjugated hyaluronan-degrading enzyme (e.g. hyaluronidase or PH20), and a tumor-targeted taxane (e.g. albumin bound-taxane) can be provided separately in the combination or provided in a single composition. If provided and administered separately, the agents can be administered simultaneously or near simultaneously, sequentially or intermittently in any order. For example, a anti-hyaluronan agent, e.g., polymer-conjugated hyaluronan-degrading enzyme (e.g. hyaluronidase or PH20) and a tumor-targeted taxane (e.g. albumin bound taxane) can be administered separately, whereby they are administered near simultaneously or are administered hours or days apart. The injection site can be the same or different. If different, the injection site can be near to the injection site of the first administered agent.

The combination of the tumor-targeted agents can be used together to treat solid tumor stromal cancers, or can be used in further combination with other chemotherapeutic agents or treatments. In particular examples, the combination of an anti-hyaluronan agent, such as a polymer-conjugated hyaluronan-degrading enzyme (e.g. hyaluronidase or PH20), and a tumor-targeted taxane (e.g. albumin bound-taxane) is used in further combination with a chemotherapeutic agent. The other agent can be a stromal or non-stromal targeting agent. Typically, the other agent is a non-stromal cytotoxic agent that exhibits direct antitumor activity. For example, the further chemotherapeutic agent can be a cytotoxic agent such as platinum (cisplatin or carboplatin), paclitaxel, gemcitabine, docetaxel, vinorelbine, irinotecan, and pemetrexed. Typically, the further chemotherapeutic agent is a nucleoside analog, such as gemcitabine. The further treatment or agent can be administered separately or together with the anti-hyaluronan agent, such as the polymer-conjugated hyaluronan-degrading enzyme (e.g. hyaluronidase), and/or a tumor-targeted taxane (e.g. albumin bound-taxane) combination therapy. The further agent can be administered separately in the combination or provided in a single composition. If provided and administered separately, the further agent can be administered simultaneously or near simultaneously, seqeuntially or intermittently in any order with the anti-hyaluronan agent and/or an albumin bound-taxane combination therapy. Typically, in order to effect enhanced delivery of the further agent, the further agent is administered after administration of the anti-hyaluronan agent and/or an albumin bound-taxane combination therapy. Due to the enhanced delivery and half-life of the further chemotherapeutic agent, the dosage of the further agent for administration can be reduced and/or the frequency of administration can be reduced compared to existing dosage regimes. The result is that the combination therapy provided herein can result in reduced side effects of the co-administered further therapeutic (e.g. nucleoside analog such as gemcitabine) compared to its administration alone or its administration with either of an anti-hyaluronan agent, e.g., hyaluronan-degrading enzyme, or tumor-targeted taxane alone.

The following sections describe exemplary anti-hyaluronan agents, including polymer-conjugated hyaluronan-degrading enzymes, tumor-targeted taxanes and other exemplary non-limiting chemotherapeutic agents for use in the combination therapy provided herein. Exemplary dosage regimes and methods for treatment of stromal solid tumor cancers also are described.

C. Combination Therapy Agents

Provided herein are combination therapies of anti-hyaluronan agents, such as hyaluronan-degrading enzymes, and a tumor targeted-taxane, such as albumin-bound paclitaxel, for use in the treatment of cancers. In particular, provided herein are combination therapies of a polymer-conjugated hyaluronan-degrading enzyme, for example a hyaluronidase, such as PEGPH20, and a tumor targeted-taxane, such as albumin-bound paclitaxel, for use in the treatment of cancers. In particular, the combination therapy provided herein is used in the treatment of any cancers characterized by solid tumors that are impenetrable because of the HA in the extracellular matrix. Exemplary of such cancers include solid tumor cancers, such as but not limited to, pancreatic cancer, breast cancer, prostate cancer, gastric cancer, colon cancer, ovarian cancer, head and neck cancer and others. The combination therapy can further include a further cytotoxic chemotherapeutic drug, for example any whose activity is increased (e.g. due to increased delivery and/or increased half-life) by one or both of the anti-hyaluronan agent, including the polymer-conjugated hyaluronan-degrading enzyme, and/or tumor-targeted taxane. For example, the further chemotherapeutic agent can be a nucleoside analog, such as gemcitabine or a derivate thereof, that exhibits direct anti-tumor activities.

1. Anti-Hyaluronan Agents

The combination therapy, including combinations and methods and use thereof, provided herein contains an anti-hyaluronan agent, such as a hyaluronan degrading enzyme, e.g., a polymer-conjugated hyaluronan-degrading enzyme. The anti-hyaluronan agent is one that can be administered so that it reaches its target, and in particular reaches a tumor cell containing elevated pericellular HA. For example, the anti-hyaluronan agent, such as a hyaluronan-degrading enzyme, can be administered by continuous infusion or injected locally, can be modified with a polymer, or is one that is aglycosylated or is modified such that it is aglycosylated or has decreased glycosylation. In one example, the provided compositions and combinations contain a hyaluronan-degrading enzyme, in particular a hyaluronidase, such as a soluble hyaluronidase (e.g. a PH20 or truncated PH20), that has been modified by conjugation to one or more polymeric molecule (polymer), typically to increase the half-life of the hyaluronan-degrading enzyme, for example, to promote prolonged/sustained treatment effects in a subject.

Hyaluronan is a component of the extracellular matrix and a major constituent of the interstitial barrier. By catalyzing the hydrolysis of hyaluronan, hyaluronan degrading enzymes lower the viscosity of hyaluronan, thereby increasing tissue permeability and increasing the absorption rate of fluids administered parenterally. As such, anti-hyaluronan agents, including hyaluronan degrading enzymes, such as hyaluronidases, have been used, for example, as spreading or dispersing agents in conjunction with other agents, drugs and proteins to enhance their dispersion and delivery.

Anti-hyaluronan agents reduce hyaluronic acid (HA; also referred to herein as hyaluronan) levels by interfering with its synthesis or increasing its degradation. For example, hyaluronan degrading enzymes, such as hyaluronidase, interfere with and degrade hyaluronic acid (HA). Treatment with agents that degrade or inhibit hyaluronan synthesis, such as hyaluronan degrading enzymes, reduce the hyaluronan such that the tissue deflates, the blood vessels expand, and more blood can flow through the site. Exemplary of such anti-hyaluronan agents are agents that inhibit hyaluronan synthesis or degrade hyaluronan.

a. Agents that Inhibit Hyaluronan Synthesis

Anti-hyaluronan agents include agents that inhibit hyaluronan synthesis, such as agents that inhibit, reduce or downregulate the expression of an HA synthase, HA synthesis inhibitors and tyrosine kinase inhibitors.

HA can be synthesized by three enzymes that are the products of three related mammalian genes identified as HA synthases, designated has-1, has-2 and has-3. Different cell types express different HAS enzymes and expression of HAS mRNAs is correlated with HA biosynthesis. It is known that silencing HAS genes in tumor cells inhibits tumor growth and metastasis. An anti-hyaluronan agent includes any agent that inhibits, reduces or downregulates the expression or level of an HA synthase. Such agents are known to one of skill in the art or can be identified.

For example, downregulation of a HAS can be accomplished by providing oligonucleotides that specifically hybridize or otherwise interact with one or more nucleic acid molecules encoding an HAS. For example, anti-hyaluronan agents that inhibit hyaluronan synthesis include antisense or sense molecules against an has gene. Such antisense or sense inhibition is typically based upon hydrogen bonding-based hybridization of oligonucleotide strands or segments such that at least one strand or segment is cleaved, degraded or otherwise rendered inoperable. In other examples, post-transcriptional gene silencing (PTGS), RNAi, ribozymes and DNAzymes can be employed. It is within the level of one skill in the art to generate such constructs based on the sequence of HAS 1 (set forth in SEQ ID NO:195), HAS2 (set forth in SEQ ID NO:196) or HAS3 (set forth in SEQ ID NO:197 or 198). It is understood in the art that the sequence of an antisense or sense compound need not be 100% complementary to that of its target nucleic acid to be specifically hybridizable. Moreover, an oligonucleotide may hybridize over one or more segments such that intervening or adjacent segments are not involved in the hybridization event (e.g. a loop structure or hairpin structure). Generally, the antisense or sense compounds have at least 70% sequence complementarity to a target region within the target nucleic acid, for example, 75% to 100% complementarity, such as 75%, 80%, 85%, 90%, 95% or 100%. Exemplary sense or antisense molecules are known in the art (see e.g. Chao et al. (2005) *J. Biol. Chem.*, 280:27513-27522; Simpson et al. (2002) *J. Biol. Chem.*, 277:10050-10057; Simpson et al. (2002) *Am. J. Path.*, 161:849; Nishida et al. (1999) *J. Biol. Chem.*, 274:21893-21899; Edward et al. (2010) *British J Dermatology*, 162:1224-1232; Udabage et al. (2005) *Cancer Res.*, 65:6139; and published U.S. Patent Application No. US20070286856).

Another exemplary anti-hyaluronan agent that is an HA synthesis inhibitor is 4-Methylumbelliferone (4-MU; 7-hydroxy-4-methylcoumarin) or a derivative thereof. 4-MU acts by reducing the UDP-GlcUA precursor pool that is required for HA synthesis. For example, in mammalian cells, HA is synthesized by HAS using UDP-glucuronic acid (UGA) and UDP-N-acetyl-D-glucosamine precursors. 4-MU interferes with the process by which UGA is generated, thereby depleting the intracellular pool of UGA and resulting in inhibition of HA synthesis. 4-MU is known to have antitumor activity (see e.g. Lokeshwar et al. (2010) *Cancer Res.*, 70:2613-23; Nakazawa et al. (2006) *Cancer Chemother. Pharmacol.*, 57:165-170; Morohashi et al. (2006) *Biochem. Biophys. Res. Comm.*, 345-1454-1459). Oral administration of 4-MU at 600 mg/kg/d reduces metastases by 64% in the B16 melanoma model (Yoshihara et al. (2005) *FEBS Lett.*, 579:2722-6). The structure of 4-MU is set forth below. Also, derivatives of 4-MU exhibit anti-cancer activity, in particular 6,7-dihydrozy-4-methyl coumarin and 5,7-dihydroxy-4-methyl coumarin (see e.g. Morohashi et al. (2006) *Biochem. Biophys. Res. Comm.*, 345-1454-1459).

4-Methylumbelliferone (4-MU; $C_{10}H_8O_3$)

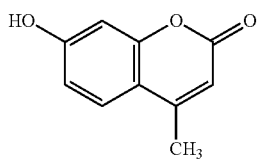

Further exemplary anti-hyaluronan agents are tyrosine kinase inhibitors, such as Leflunomide (Arava), genistein or erbstatin. Leflunomide also is a pyrimidine synthesis inhibitor. Leflunomide is a known drug for the treatment of Rheumatoid arthritis (RA), and also is effective in treating the rejection of allografts as well as xenografts. HA is known to directly or indirectly contribute to RA (see e.g. Stuhlmeier (2005) *J. Immunol.*, 174:7376-7382). Tyrosine kinase inhibitors inhibit HAS1 gene expression (Stuhlmeier 2005).

b. Hyaluronan-Degrading Enzymes and Polymer-Conjugated Hyaluronan-Degrading Enzymes Anti-hyaluronan agents include hyaluronan degrading enzymes. Hyaluronan degrading enzymes, such as hyaluronidases, are a family of enzymes that degrade hyaluronan, which is an essential component of the extracellular matrix and a major constituent of the interstitial barrier. Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating β-1→4 and β-1→3 glycosidic bonds. Hyaluronan chains can reach about 25,000 disaccharide repeats or more in length and polymers of hyaluronan can range in size from about 5,000 to 20,000,000 Da in vivo. By catalyzing the hydrolysis of hyaluronan, a major constituent of the interstitial barrier, hyaluronan degrading enzymes lower the viscosity of hyaluronan, thereby increasing tissue permeability.

Accordingly, hyaluronan degrading enzymes for the combinations, uses and methods provided include any enzyme having the ability to catalyze the cleavage of a hyaluronan disaccharide chain or polymer. In some examples the hyaluronan degrading enzyme cleaves the β-1→4 glycosidic bond in the hyaluronan chain or polymer. In other examples, the hyaluronan degrading enzyme catalyze the cleavage of the β-1→3 glycosidic bond in the hyaluronan chain or polymer.

Hyaluronan-degrading enzymes include hyaluronidases, as well as other enzymes such as chondrotinases and lyases that have the ability to cleave hyaluronan. Further, hyaluronan-degrading enzymes also include soluble forms thereof that can be expressed and secreted from cells. As described below, hyaluronan-degrading enzymes exist in membrane-bound or soluble forms that are secreted from cells. For purposes herein, soluble hyaluronan-degrading enzymes are provided for use in the combinations, methods and uses herein. Thus, where hyaluronan-degrading enzymes include a glycosylphosphatidylinositol (GPI) anchor and/or are otherwise membrane-anchored or insoluble, such hyaluronan-degrading enzymes can be provided in soluble form by truncation or deletion of the GPI anchor to render the enzyme secreted and soluble. Thus, hyaluronan-degrading enzymes include truncated variants, e.g. truncated to remove all or a portion of a GPI anchor. Exemplary of such soluble hyaluronidases are soluble PH20 hyaluronides, such as any set forth in (U.S. Pat. No. 7,767,429; U.S. Publication Nos. US20040268425 or US20100143457.

Hyaluronan-degrading enzymes provided herein also include variants of any hyaluronan-degrading enzyme, such as any hyaluronidase or soluble hyaluronidase, for example a PH20, that is known to one of skill in the art or described herein. For example, hyaluronan degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art and described herein). For example, exemplary of hyaluronan-degrading enzymes, including those that can be conjugated to a polymer, are any set forth in any of SEQ ID NOS: 2, 4-9, 47, 48, 150-170, 183-189 and 199-210, or any that exhibit at least or about 60%, 70%, 80%, 90%, 91%, 92%, 93%, 94%, 95%, 96%, 97%, 98%, 99% or more sequence identity to any of SEQ ID NOS: 2, 4-9, 47, 48, 150-170, 183-189 and 199-210.

Various forms of hyaluronan degrading enzymes, including hyaluronidases have been prepared and approved for therapeutic use in subjects, including humans. For example, animal-derived hyaluronidase preparations include Vitrase®

(ISTA Pharmaceuticals), a purified ovine testicular hyaluronidase, Amphadase® (Amphastar Pharmaceuticals), a bovine testicular hyaluronidase and HydaseTM (Prima Pharm Inc.), a bovine testicular hyaluronidase. Hylenex® (Halozyme Therapeutics) is a human recombinant hyaluronidase produced by genetically engineered Chinese Hamster Ovary (CHO) cells containing nucleic acid encoding soluble forms of PH20, designated rHuPH20 (see e.g., U.S. Publication Nos. US20040268425 ; U.S. Patent No. 7,767,429). It is understood that any hyaluronidase preparation can be used in the combinations, methods and uses provided herein, see, e.g., U.S. Pat. Nos. 2,488,564, 2,488,565, 2,676,139, 2,795,529, 2,806,815, 2,808,362, 5,747,027 and 5,827,721 and International PCT Publication No. WO2005/118799; U.S. Publication Nos. US20040268425; U.S. Pat. No. 7,767,429; or any provided herein.

A non-limiting description of exemplary hyaluronan-degrading enzymes, such as hyaluronidase enzymes or soluble hyaluronidase enzyme, for example PH20, for use in the combinations and methods provided herein are described below. Generally, such hyaluronan-degrading enzymes include those that are conjugated to a polymer.

i. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Other hyaluronidases are known such as yellow jacket wasp (SEQ ID NOS:12 and 13), honey bee (SEQ ID NO:14), white-face hornet (SEQ ID NO:15) and paper wasp (SEQ ID NO:16). Any of such enzymes can be used in the compositions, combinations and methods provided herein.

(a) Mammalian-Type Hyaluronidases

Mammalian-type hyaluronidases (EC 3.2.1.35) are endo-β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, from cows (bovine) (SEQ ID NOS:10, 11, 64, 203 and 204 and nucleic acid molecules set forth in SEQ ID NOS:190-192), sheep (*Ovis aries*) (SEQ ID NO: 26, 27, 63 and 65, nucleic acid molecules set forth in SEQ ID NOS:66 and 193-194), pig (SEQ ID NOS:20-21), mouse (SEQ ID NOS:17-19, 32, 205), rat (SEQ ID NOS: 22-24, 31, 206), rabbit (SEQ ID NO:25, 207), orangutan (SEQ ID NO:28), cynomolgus monkey (SEQ ID NO:29, 202), guinea pig (SEQ ID NO:30, 208), chimpanzee (SEQ ID NO:101, 199, 200), rhesus monkey (SEQ ID NO:102, 201), fox (SEQ ID NO: 209 and 210) and human hyaluronidases (SEQ ID NOS:1-2, 36-39). The above hyaluronidases include PH20 hyaluronidases. Also, BH55 hyaluronidase is of this type as described in U.S. Pat. Nos. 5,747,027 and 5,827,721. Exemplary of hyaluronidases in the compositions, combinations and methods provided herein are soluble hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NOS:27, 63 and 65), bovine (SEQ ID NO:11 and 64) and human (SEQ ID NO:1). Human PH20 (also known as SPAM 1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and PH20 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e. pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova et al. (2003) *Proc Natl Acad Sci USA* 100(8): 4580-4585), and those which are generally soluble such as human HYAL1 (Frost et al. (1997) *Biochem Biophys Res Commun.* 236(1):10-15).

PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. It has both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins, including precursor and mature forms, include, but are not limited to, human (precursor polypeptide set forth in SEQ ID NO:1, mature polypeptide set forth in SEQ ID NO: 2), chimpanzee (SEQ ID NO:101, 199, 200), Rhesus monkey (SEQ ID NO:102, 201) bovine (SEQ ID NOS: 11 and 64, 203, 204), rabbit (SEQ ID NO: 25, 207), ovine PH20 (SEQ ID NOS: 27, 63 and 65), Cynomolgus monkey (SEQ ID NO: 29, 202), guinea pig (SEQ ID NO: 30, 208), rat (SEQ ID NO: 31, 206), mouse (SEQ ID NO: 32, 205) and fox (SEQ ID NO: 209 and 210) PH20 polypeptides.

Bovine PH20 is a 553 amino acid precursor polypeptide (SEQ ID NO:11). Alignment of bovine PH20 with the human PH20 shows only weak homology, with multiple gaps existing from amino acid 470 through to the respective carboxy termini due to the absence of a GPI anchor in the bovine polypeptide (see e.g., Frost (2007) *Expert Opin. Drug. Deliv.* 4:427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-636). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO:1) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 therefore, is a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Human PH20 exhibits hyaluronidase activity at neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at neutral and acid pH. It appears that PH20 contains two catalytic sites at distinct regions of the polypeptide: the Peptide 1 and Peptide 3 regions (Chem et al., (2001) *Matrix Biology* 20:515-525). Evidence indicates that the Peptide 1 region of PH20, which corresponds to amino acid positions 107-137 of the mature polypeptide set forth in SEQ ID NO:2 and positions 142-172 of the precursor polypeptide set forth in SEQ ID NO:1, is required for enzyme activity at neutral pH. Amino acids at positions 111 and 113 (corresponding to the mature PH20 polypeptide set forth in SEQ ID NO:2) within this region appear to be important for activity, as mutagenesis by amino acid replacement results in PH20 polypeptides with 3% hyaluronidase activity or undetectable hyaluronidase activity, respectively, compared to the wild-type PH20 (Arming et al., (1997) *Eur. J. Biochem.* 247:810-814).

The Peptide 3 region, which corresponds to amino acid positions 242-262 of the mature polypeptide set forth in SEQ ID NO:2, and positions 277-297 of the precursor polypeptide set forth in SEQ ID NO: 1, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) *Eur. J. Biochem.* 247:810-814).

In addition to the catalytic sites, PH20 also contains a hyaluronan-binding site. Experimental evidence indicate that this site is located in the Peptide 2 region, which corresponds to amino acid positions 205-235 of the precursor polypeptide set forth in SEQ ID NO: 1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) *Eur. J. Biochem.* 247:810-814).

There are seven potential glycosylation sites, including N- and O-linked glycosylation sites, in human PH20 at N82, N166, N235, N254, N368, N393 and S490 of the polypeptide exemplified in SEQ ID NO: 1. Because amino acids 36 to 464 of SEQ ID NO:1 appear to contain the minimally active human PH20 hyaluronidase domain, the glycosylation site at S490 is not required for proper hyaluronidase activity. There are six disulfide bonds in human PH20. Two disulfide bonds between the cysteine residues C60 and C351 and between C224 and C238 of the polypeptide exemplified in SEQ ID NO: 1 (corresponding to residues C25 and C316, and C189 and C203 of the mature polypeptide set forth in SEQ ID NO:2, respectively). A further four disulfide bonds are formed between between the cysteine residues C376 and C387; between C381 and C435; between C437 and C443; and between C458 and C464 of the polypeptide exemplified in SEQ ID NO: 1 (corresponding to residues C341 and C352; between C346 and C400; between C402 and C408; and between C423 and C429 of the mature polypeptide set forth in SEQ ID NO:2, respectively).

(b) Bacterial Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan degrading enzymes in microorganisms, including strains of *Arthrobacter*, *Bdellovibrio*, *Clostridium*, *Micrococcus*, *Streptococcus*, *Peptococcus*, *Propionibacterium*, *Bacteroides*, and *Streptomyces*. Particular examples of such strains and enzymes include, but are not limited to *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); and serotype III (SEQ ID NO:73)), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); and strain USA300 (SEQ ID NO:81)), *Streptococcus pneumoniae* ((SEQ ID NO:82); strain ATCC BAA-255/R6 (SEQ ID NO:83); and serotype 2, strain D39/NCTC 7466 (SEQ ID NO:84)), *Streptococcus pyogenes* (serotype M1 (SEQ ID NO:85); serotype M2, strain MGAS 10270 (SEQ ID NO:86); serotype M4, strain MGAS 10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); and serotype M28 (SEQ ID NO:92)); *Streptococcus suis* (SEQ ID NOS:93-95); *Vibrio fischeri* (strain ATCC 700601/ES 114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) Biochim. Biophys. Acta 198:607).

(c) Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of 1→3-linkages between β-D-glucuronate and N-acetyl-D-glucosamine residues in hyaluronate. Exemplary hyaluronidases from leeches include, but are not limited to, hyaluronidase from Hirudimidae (e.g., *Hirudo medicinalis*), Erpobdellidae (e.g., *Nephelopsis obscura* and *Erpobdella punctata*), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol. Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

ii. Other Hyaluronan Degrading Enzymes

In addition to the hyaluronidase family, other hyaluronan degrading enzymes can be used in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7):1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol. Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272:9123-9130). Exemplary chondroitin-sulfate-ABC endolyases and chondroitin-sulfate-ABC exolyases include, but are not limited to, those from *Proteus vulgaris* and *Flavobacterium* heparinum (the *Proteus vulgaris* chondroitin-sulfate-ABC endolyase is set forth in SEQ ID NO: 98 (Sato et al. (1994) *Appl. Microbiol. Biotechnol.* 41(1): 39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS:99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133).

iii. Soluble Hyaluronan Degrading Enzymes

Provided in the compositions, combinations, uses and methods herein are soluble hyaluronan degrading enzymes, including soluble hyaluronidases. Soluble hyaluronan degrading enzymes include any hyaluronan degrading enzymes that are secreted from cells (e.g. CHO cell) upon expression and exist in soluble form. Such enzymes include, but are not limited to, soluble hyaluronidases, including non-human soluble hyaluronidases, including non-human animal soluble hyaluronidases, bacterial soluble hyaluronidases and human hyaluronidases, Hyal1, bovine PH20 and ovine PH20, allelic variants thereof and other variants thereof. For example, included among soluble hyaluronan degrading enzymes are any hyaluronan degrading enzymes that have been modified to be soluble. For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods herein is a soluble neutral active hyaluronidase.

Exemplary of hyaluronidases include a soluble form of a PH20 from any species, such as a soluble form of a PH20 of any of SEQ ID NOS: 1, 2, 11, 25, 27, 29-32, 63-65, 101-102 and 199-210. Such soluble forms include truncated forms thereof lacking all or a portion of the C-terminal GPI anchor, so long as the hyaluronidase is soluble (secreted upon expression) and retains hyaluronidase activity. Such forms also typically are mature forms that, when expressed in a cell, lack the signal peptide. Also included among soluble hyaluronidases are soluble forms of variants of any of the PH20s from any species set forth in SEQ ID NOS:1, 2, 11, 25, 27, 29-32, 63-65,101-102 and 199-210, or truncated forms thereof, that exhibit hyaluronidase activity. Variants include polypeptides having 60%, 70%, 80%, 90%, 91%, 92%, 93%, 94%, 95%, 96%, 97%, 98%, 99% or more sequence identity to any of SEQ ID NOS: 1, 2, 11, 25, 27, 29-32, 63-65, 101-102 and 199-210, mature (e.g. lacking the signal sequence) or truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

In some instances, the soluble hyaluronan degrading enzyme is normally GPI-anchored (such as, for example, human PH20) and is rendered soluble by truncation at the C-terminus. Such truncation can remove all of the GPI anchor attachment signal sequence, or can remove only some of the GPI anchor attachment signal sequence. The resulting polypeptide, however, is soluble. In instances where the soluble hyaluronan degrading enzyme retains a portion of the GPI anchor attachment signal sequence, 1, 2, 3, 4, 5, 6, 7 or more amino acid residues in the GPI-anchor attachment signal sequence can be retained, provided the polypeptide is soluble. Polypeptides containing one or more amino acids of the GPI anchor are termed extended soluble hyaluronan degrading enzymes. One of skill in the art can determine whether a polypeptide is GPI-anchored using methods well known in the art. Such methods include, but are not limited to, using known algorithms to predict the presence and location of the GPI-anchor attachment signal sequence and co-site, and performing solubility analyses before and after digestion with phosphatidylinositol-specific phospholipase C (PI-PLC) or D (PI-PLD).

Extended soluble hyaluronan degrading enzymes can be produced by making C-terminal truncations to any naturally GPI-anchored hyaluronan degrading enzyme such that the resulting polypeptide is soluble and contains one or more amino acid residues from the GPI-anchor attachment signal sequence (see, e.g., U.S. Published Pat. Appl. No. US20100143457). Exemplary extended soluble hyaluronan degrading enzymes that are C-terminally truncated but retain a portion of the GPI anchor attachment signal sequence include, but are not limited to, extended soluble PH20 (esPH20) polypeptides of primate origin, such as, for example, human and chimpanzee esPH20 polypeptides. For example, the esPH20 polypeptides can be made by C-terminal truncation of any of the mature or precursor polypeptides set forth in SEQ ID NOS:1, 2, 50, 51 or 101, or other variants thereof, including active fragment thereof, wherein the resulting polypeptide is soluble and retains one or more amino acid residues from the GPI-anchor attachment signal sequence. Variants include polypeptides having 60%, 70%, 80%, 90%, 91%, 92%, 93%, 94%, 95% or more sequence identity to any of SEQ ID NOS: 1, 2, 50, 51 or 101 that retain hyaluronidase activity. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 1, 2, 50, 51 or 101, provided the resulting esPH20 polypeptide is soluble and retains 1 or more amino acid residues from the GPI-anchor attachment signal sequence.

Typically, for use in the compositions, combinations and methods herein, a soluble human hyaluronan degrading enzyme, such as a soluble human PH20, is used. Although hyaluronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

(a) Soluble Human PH20

Exemplary of a soluble hyaluronidase is soluble human PH20. Soluble forms of recombinant human PH20 have been produced and can be used in the compositions, combinations and methods described herein. The production of such soluble forms of PH20 is described in U.S. Published Patent Application Nos. US20040268425; US20050260186, US20060104968, US20100143457 and International PCT Publication No. WO2009111066. For example, soluble PH20 polypeptides, include C-terminally truncated variant polypeptides that include a sequence of amino acids in SEQ ID NO:1 or 2, or have at least 91%, 92%, 93%, 94%, 95%, 96%, 97%, or 98% sequence identity to a sequence of amino acids included in SEQ ID NO:1 or 2, retain hyaluronidase activity and are soluble. Included among these polypeptides are soluble PH20 polypeptides that completely lack all or a portion of the GPI-anchor attachment signal sequence.

Also included are extended soluble PH20 (esPH20) polypeptides that contain at least one amino acid of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NOS:1 or 2, or allelic or species variants or other variants thereof.

For example, soluble forms include, but are not limited to, C-terminal truncated polypeptides of human PH20 set forth in SEQ ID NO:1 having a C-terminal amino acid residue 467, 468, 469, 470, 471, 472, 473, 474, 475, 476, 477, 478, 479, 480, 481, 482 and 483, 484, 485, 486, 487, 488, 489, 490, 491, 492, 493, 494, 495, 496, 497, 498, 499 or 500 of the sequence of amino acids set forth in SEQ ID NO:1, or polypeptides that exhibit at least 85% identity thereto. Soluble forms of human PH20 generally include those that contain amino acids 36-464 set forth in SEQ ID NO:1. For example, when expressed in mammalian cells, the 35 amino acid N-terminal signal sequence is cleaved during processing, and the mature form of the protein is secreted. Thus, the mature soluble polypeptides contain amino acids 36 to 467, 468, 469, 470, 471, 472, 473, 474, 475, 476, 477, 478, 479, 480, 481, 482 and 483 of SEQ ID NO:1. Table 3 provides non-limiting examples of exemplary C-terminally truncated PH20 polypeptides, including C-terminally truncated soluble PH20 polypeptides. In Table 3 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 3 for comparison. In particular, exemplary of soluble hyaluronidases are soluble human PH20 polypeptides that are 442, 443, 444, 445, 446 or 447 amino acids in length, such as set forth in any of SEQ ID NOS: 4-9, or allelic or species variants or other variants thereof.

TABLE 3

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-SILF | 500 | 139 | 465 | 183 |
| SPAM-VSIL | 499 | 106 | 464 | 150 |
| SPAM1-IVSI | 498 | 140 | 463 | 184 |
| SPAM1-FIVS | 497 | 107 | 462 | 151 |
| SPAM1-MFIV | 496 | 141 | 461 | 185 |
| SPAM1-TMFI | 495 | 108 | 460 | 152 |
| SPAM1-ATMF | 494 | 142 | 459 | 186 |
| SPAM1-SATM | 493 | 109 | 458 | 153 |
| SPAM1-LSAT | 492 | 143 | 457 | 187 |
| SPAM1-TLSA | 491 | 110 | 456 | 154 |
| SPAM1-STLS | 490 | 112 | 455 | 156 |
| SPAM1-PSTL | 489 | 111 | 454 | 155 |
| SPAM1-SPST | 488 | 144 | 453 | 188 |
| SPAM1-ASPS | 487 | 113 | 452 | 157 |
| SPAM1-NASP | 486 | 145 | 451 | 189 |
| SPAM1-YNAS | 485 | 114 | 450 | 158 |
| SPAM1-FYNA | 484 | 115 | 449 | 159 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |
| SPAM1-TEEP | 478 | 42 | 443 | 8 |
| SPAM1-ETEE | 477 | 41 | 442 | 9 |
| SPAM1-METE | 476 | 116 | 441 | 160 |
| SPAM1-PMET | 475 | 117 | 440 | 161 |
| SPAM1-PPME | 474 | 118 | 439 | 162 |
| SPAM1-KPPM | 473 | 119 | 438 | 163 |
| SPAM1-LKPP | 472 | 120 | 437 | 164 |
| SPAM1-FLKP | 471 | 121 | 436 | 165 |
| SPAM1-AFLK | 470 | 122 | 435 | 166 |
| SPAM1-DAFL | 469 | 123 | 434 | 167 |
| SPAM1-IDAF | 468 | 124 | 433 | 168 |
| SPAM1-CIDA | 467 | 40 | 432 | 47 |
| SPAM1-VCID | 466 | 125 | 431 | 169 |
| SPAM1-GVCI | 465 | 126 | 430 | 170 |

For example, soluble forms of PH20 include, for example, polypeptide that has the sequence of amino acids set forth in any of SEQ ID NOS: 4-9, 47, 48, 150-170, 183-189, or a sequence of amino acids that exhibits at least 85%, 86%, 87%, 88%, 89%, 90%, 91%, 92%, 93%, 94%, 95%, 96%, 97%, 98% or 99% sequence identity to a sequence of amino acids set forth in any of SEQ ID NOS: 4-9, 47, 48, 150-170, 183-189 and retains hyaluronidase activity.

Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

(b)rHuPH20

Recombinant soluble forms of human PH20 have been generated and can be used in the compositions, combinations and methods provided herein. The generation of such soluble forms of recombinant human PH20 are described, for example, in U.S. Published Patent Application Nos. US20040268425; US 20050260186; US20060104968; US20100143457; and International PCT Appl. No. WO2009111066. Exemplary of such polypeptides are those generated by expression of a nucleic acid molecule encoding amino acids 1-482 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS. 4-9 in various abundance. Typically, rHuPH20 is produced in cells that facilitate correct N-glycosylation to retain activity, such as CHO cells (e.g. DG44 CHO cells).

iv. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc- cores attached via the amide nitrogen of Asn residues that fall within -Asn-Xaa-Thr/Ser-sequences (where Xaa is not Pro). Glycosylation at an -Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides. There are six potential N-linked glycosylation sites at N82, N166, N235, N254, N368, N393 of human PH20 exemplified in SEQ ID NO: 1. Amino acid residues N82, N166 and N254 are occupied by complex type glycans whereas amino acid residues N368 and N393 are occupied by high mannose type glycans. Amino acid residue N235 is occupied by approximately 80% high mannose type glycans and 20% complex type glycans. As noted above, O-linked glycosylation at S490 is not required for hyaluronidase activity.

In some examples, the hyaluronan degrading enzymes for use in the compositions, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO: 1 are glycosylated. In some examples the hyaluronan degrading enzymes are glycosylated at one or more native glycosylation sites. In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes for use in the compositions, combinations and/or methods provided herein are partially deglycosylated (or N-partially glycosylated polypeptides). For example, partially deglycosylated soluble PH20 polypeptides that retain all or a portion of the hyaluronidase activity of a fully glycosylated hyaluronidase can be used in the compositions, combinations and/or methods provided herein. Exemplary partially deglycosylated hyalurodinases include soluble forms of a partially deglycosylated PH20 polypeptides from any species, such as any set forth in any of SEQ ID NOS: 1, 2, 11, 25, 27, 29-32, 63, 65, 101-102 and 199-210, or allelic variants, truncated variants, or other variants thereof. Such variants are known to one of skill in the art, and include polypeptides having 60%, 70%, 80%, 90%, 91%, 92%, 93%, 94%, 95% or more sequence identity to any of SEQ ID NOS: 1, 2, 11, 25, 27, 29-32, 63, 65, 101-102 and 199-210, or truncated forms thereof. The partially deglycosylated hyaluronidases provided herein also include hybrid, fusion and chimeric partially deglycosylated hyaluronidases, and partially deglycosylated hyaluronidase conjugates.

Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. Treatment of a hyaluronan degrading enzyme, such as a soluble hyaluronidase, such as a soluble PH20, with one or all of these glycosidases can result in only partial deglycosylation and, therefore, retention of hyaluronidase activity.

Partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. For example, treatment of PH20 (e.g. a recombinant PH20 designated rHuPH20) with one or all of the above glycosidases (e.g. EndoF1, EndoF2 and/or EndoF3) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that removes all N-glycans, results in complete removal of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO: 1) can be glycosylated, treatment with one or more glycosidases can render the extent of glycosylation reduced compared to a hyaluronidase that is not digested with one or more glycosidases.

The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. In one example, 1, 2, 3, 4, 5 or 6 of the N-glycosylation sites corresponding to amino acids N82, N166, N235, N254, N368, and N393 of SEQ ID NO:1 are partially deglycosylated, such that they no longer contain high mannose or complex type glycans, but rather contain at least an N-acetylglucosamine moiety. In some examples, 1, 2 or 3 of the N-glycosylation sites corresponding to amino acids N82, N166 and N254 of SEQ ID NO:1 are deglycosylated, that is, they do not contain a sugar moiety. In other examples, 3, 4, 5, or 6 of the N-glycosylation sites corresponding to amino acids N82, N166, N235, N254, N368, and N393 of SEQ ID NO:1 are glycosylated. Glycosylated amino acid residues minimally contain an N-acetylglucosamine moiety. Typically, the partially deglyclosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

v. Modified (Polymer-Conjugated) Hyaluronan Degrading Enzymes

Covalent or other stable attachment (conjugation) of polymeric molecules, such as polyethylene glycol (PEGylation moiety (PEG)), to the hyaluronan degrading enzymes, such as hyaluronidases, impart beneficial properties to the resulting hyaluronan degrading enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan degrading enzyme, such as the hyaluronidase, include natural and synthetic homopolymers, such as polyols (i.e. poly-OH), polyamines (i.e. poly-NH$_2$) and polycarboxyl acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGS), polyvinyl alcohol (PVA), poly(ethyleneimine) (PEI), linear polyamidoamines, polyacrylamide (PAAm), polydimethylacrylamide (PDAAm), polyvinyl alchol (PVA), polycarboxylates, polyvinylpyrrolidone (PVP), poly-D,L-amino acids, polyethylene-co-maleic acid anhydride, polystyrene-co-maleic acid anhydride, dextrans including carboxymethyl-chitosan, dextrin, dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran and pullulan, have few reactive groups capable of crosslinking. Typically, the polymers are non-toxic polymeric molecules such as (m) polyethylene glycol (mPEG) which can be covalently conjugated to the hyaluronan degrading enzyme, such as the hyaluronidase (e.g. to attachment groups on the protein's surface) using a relatively simple chemistry.

PEGylation of therapeutics has been reported to increase resistance to proteolysis, increase plasma half-life, and decrease antigenicity and immunogenicity. Examples of PEGylation methodologies are known in the art (see for example, Lu and Felix, *Int. J. Peptide Protein Res.*, 43:127-138, 1994; Lu and Felix, *Peptide Res.*, 6:140-6, 1993; Felix et al., *Int. J. Peptide Res.*, 46:253-64, 1995; Benhar et al., *J. Biol. Chem.*, 269: 13398-404, 1994; Brumeanu et al., *J. Immunol.*, 154:3088-95, 1995; see also, Caliceti et al. (2003) *Adv. Drug Deliv. Rev.* 55(10):1261-77 and Molineux (2003) *Pharmacotherapy* 23 (8 Pt 2):3S-8S). PEGylation also can be used in the delivery of nucleic acid molecules in vivo. For example, PEGylation of adenovirus can increase stability and gene transfer (see, e.g., Cheng et al. (2003) *Pharm. Res.* 20(9):1444-51).

Suitable polymeric molecules for attachment to the hyaluronan degrading enzymes, including hyaluronidases, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., *Advanced Drug Delivery Review* (2002) 54: 459-476; Harris and Zalipsky, S (eds.) "Poly(ethylene glycol), Chemistry and Biological Applications" ACS Symposium Series 680, 1997; Mehvar et al., *J. Pharm. Pharmaceut. Sci.*, 3(1):125-136, 2000; Harris, (2003) *Nature Reviews Drug Discovery* 2:214-221; and Tsubery, (2004) *J Biol. Chem.* 279(37):38118-24). The polymeric molecule can be of a molecular weight typically ranging from about 3 kDa to about 60 kDa. In some embodiments the polymeric molecule that is conjugated to a protein, such as a hyaluronidase, for example a PH20, has a molecular weight of between or about between 5 to 60 kDa, such as at least or about at least or 5, 10, 15, 20, 25, 30, 35, 40, 45, 50, 55, 60 or more than 60 kDa.

PEGylated Soluble Hyaluronan Degrading Enzymes

The hyaluronan degrading enzyme used in the combinations and methods herein can be a PEGylated hyaluronan degrading enzyme, such as a PEGylated soluble hyaluronan degrading enzyme. In one example, it is a PEGylated soluble hyaluronidase, e.g. PEGylated PH20. Various methods of modifying polypeptides by covalently attaching (conjugating) a PEG or PEG derivative (i.e. "PEGylation") are known in the art (see e.g., U.S. 2006/0104968; U.S. Pat. Nos. 5,672,662; 6,737,505; and U.S. 2004/0235734). Techniques for PEGylation include, but are not limited to, specialized linkers and coupling chemistries (see e.g., Roberts et al., *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.*, 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butyraldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. Nos. 5,672,662; 5,932,462; 6,495,659; 6,737,505; 4,002,531; 4,179,337; 5,122,614; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO0500360; U.S. 2005/0114037; U.S. 2005/0171328; U.S. 2005/0209416; EP 1064951; EP 0822199; WO 01076640; WO 0002017; WO 0249673; WO 9428024; and WO 0187925).

2. Taxanes and Formulations Thereof

The combination therapy, including compositions, combinations and methods and use thereof, provided herein contains a taxane. Taxanes are generally poorly water soluble, which has limited their therapeutic use. In the compositions and combinations provided herein, the taxanes are provided as formulations that exhibit water solubility. In particular examples provided herein, the taxanes are provided as formulations that target and/or penetrate the stroma or cells of a tumor. Exemplary of such a taxane formulation is an albumin-bound taxane.

a. Taxanes

Taxanes are diterpenes that are produced from plants of the genus *Taxus* (yews). Taxanes are anti-mitotic agents that bind to tubulin and act to stabilize microtubule polymerization, thereby disrupting the normal equilibrium involved in microtubule assembly and deconstruction and retarding microtubule functioning. While taxanes promote formation of microtubules, they prevent depolymerization of the tubulin forming the microtubules of the mitotic spindle. Microtubules are essential to cell division and cells exposed to taxanes are arrested in the premitotic G2 phase and fail to divide. These drugs thus interfere with the cell division process as cells treated with these drugs are held in mitosis. This can eventually result in cell death due to unsuccessful mitosis.

Taxanes also generate reactive oxygen species (ROS), including $O_2$ and $H_2O_2$ accumulation, in treated cells. The accumulation of ROS is associated with direct cytotoxic activity of taxanes, including paclitaxel, as well as bystander effects on neighboring cells (see e.g. Alexandre et al. (2007) *Cancer Res.*, 67:3512).

Taxanes for use in the compositions, combinations and methods provided herein include any diterpene compound that inhibits the depolymerization of tubulin. In particular, such taxanes also include any that result in the accumulation of ROS in treated cells. Taxanes include those that are purified forms of a naturally produced diterpene or those that are synthesized artificially. Taxanes includes those that are non-crystalline and/or amorphous. Taxanes also can include anhydrous forms of a taxane.

Paclitaxel (taxol) is a naturally occurring diterpenoid. It has the chemical name 5β,20-epoxy-1,2α,4,7β,10β,13α-hexahydroxytax-11-en-9-one 4,10-diacetate 2-benzoate. Taxol is found in the stem bark of the Western Yew, *Taxus brevifolia*, as well as in *T. baccata* and *T. cuspidata*. It was first isolated from the bark of the Pacific yew tree, *Taxus brevifolia* (Wani et al. (1971) J. Am. Chem. Soc., 93:2325).

A. The core structure of paclitaxel contains four rings (six membered A and C rings, eight membered B ring and four membered D ring). The structure of paclitaxel is set forth below, with numbering shown using the conventional numbering system for this class of drugs.

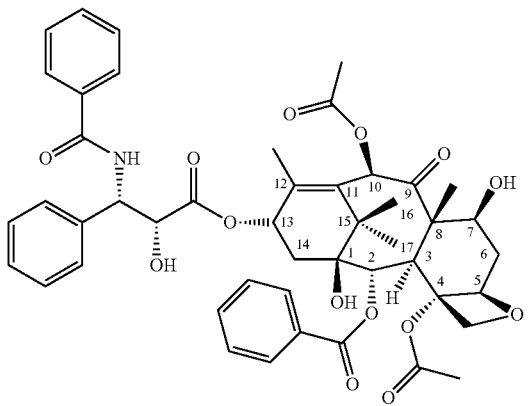

Paclitaxel can be prepared by semi-synthetic methods from precursor chemicals called baccatins, which are derived from the needles and twigs of the European or Himalayan yew tree. For example, Paclitaxel can be prepared from baccatin by attachment of protecting groups to the hydroxyl groups of baccatin that are to become the hydroxyl groups of paclitaxel, converting the precursor baccatin to paclitaxel, and then removing the protecting groups from the hydroxyl groups to obtain paclitaxel. In addition, paclitaxel has recently been synthesized from simple precursors. (See, e.g., International PCT Publication No. WO93/10076, WO93/16059; U.S. Pat. Nos. 5,200,534; 5,015,744; 4,960,790; Nicolaou (1993) Nature 364: 464-466; Nicolaou, K. C. et al. (1994) Nature, 367:630-634; and Holton et al. (1994) J. Am. Chem. Soc., 116: 1597-1600).

Docetaxel (taxotere) is another exemplary taxane for use in the combinations and compositions provided herein. Docetaxel has the chemical name 1,7β,10β-trihydroxy-9-oxo-5β,20-epoxytax-[1-ene-2α,4,13α-triyl 4-acetate 2-benzoate 13-{(2R,3S)-3-[(tert-butoxycarbonyl]amino]-2-hydroxy-3-phenylpropanoate and has the structure set forth below with numbering shown using the conventional numbering system for this class of drugs.

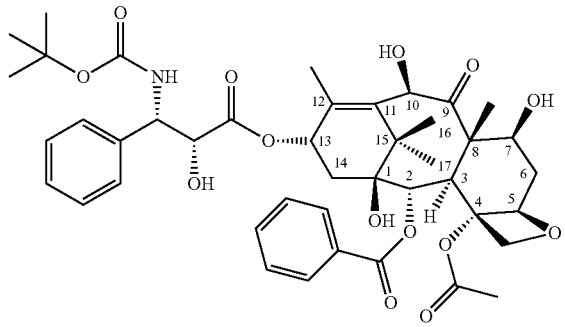

Docetaxel is a semi-synthetic, second-generation taxane derived from a compound found in the European yew tree Taxus baccata. Docetaxel is an esterified product of 10-deacetyl baccatin III, which is extracted from the European yew tree. It differs from paclitaxel at two positions in its chemical structure: it lacks an acetate ester, and a tert-butyl carbamate ester exists on the phenylpropionate side chain instead of the benzyl amide in paclitaxel. Docetaxel, an analog of paclitaxel, is semisynthetically produced from 10-deacetyl baccatin III, a non-cytotoxic precursor extracted from the needles of Taxus baccata and esterified with a chemically synthesized side chain (Cortes and Pazdur, 1995, J. Clin. Oncol. 13(10):2643-55).

Taxanes for use in the compositions, combinations and methods provided herein include analogs, derivatives and prodrug forms of paclitaxel or docetaxel. Such taxane derivatives include those that exhibit improved aqueous solubility compared to paclitaxel of docetaxel. For example, taxane derivatives, analogs and prodrug forms include those where ring positions are modified or derivatized, and in particular where the 2'- and 7 or 10-position is derivatized with a suitable groups (see e.g. Fu et al. (2009) Current Medicinal Chemistry, 16:1-13).

For example, taxane derivatives, analogs or prodrug forms include, but are not limited to, water soluble taxols having various substituted acyl groups at 2'-O-position (see e.g. U.S. Pat. No. 4,942,184); water soluble taxols, whereby the 2' and/or 7' hydroxy is derivatized with a selected amino acid or an amino acid mimetic compound (see e.g. U.S. Pat. No. 4,960,790); sulfonated 2'-acryloyl, sulfonated 2'-O-acyl acid taxol and substituted 2'- benzoyl and 2'7-dibenzoyl taxol (see e.g. U.S. Pat. Nos. 5, 352,805 and 5,411,984); 2'and/or 7-O-ester and 2'-and/or 7-O-carbonate derivatives of taxol (see e.g. U.S. Pat. No. 5,817,840); taxane derivatives formed by conjugation with polymers such as polyethylene glycol, poly(L-glutamic acid), poly(L-aspartic acid) (see e.g. U.S. Pat. No. 5,977,163); prodrug forms of taxane possessing a phosphonooxy group at the C-7, C-10 and/or the 2'position of the side chain of a taxane (see e.g. WO9414787); salts of 2'-succinylpaclitaxel and 2'glutaryl-paclitaxel (Deutch et al. (1989) J Med. Chem., 32:788-792); 2' and 7-amino acid derivatives of paclitaxel and their salts (Matthew et al. (1992)J Med. Chem., 35:145-151; sulfonate derivatives (Zhao et al. (1991) JNat. Prod., 54:1607-1611; 7-phosphate paclitaxel analogues (Vyas et al. (1993) Bioorg. Med. Chem., Lett., 3:1357-1360); 2'and 7-polyethylene glycol esters of paclitaxel (Greenwald et al. (1995) J. Org. Chem., 60:331-336; Greenwald et al. (1996) J. Med. Chem., 39:424-431); 2' and 7-Phosphonoxyphenyl-propionate paclitaxel (Ueda et al. (1993) Bioorg. Med. Chem. Lett., 3:1761-1766); 2'and 7-Methylpyridinium acetate analogues of paclitaxel (Nicolaou et al. (1994) Angew Chemie, 106: 1672-1675); Paloma et al. (1994) Chem. Biol., 1:107-112); prodrug of paclitaxel with malic acid at the 2' position (Damen et al. (2000) Bioorg. Med. Chem. Lett., 8:427-432); sulfonate salts of taxanes and in particular of taxol (U.S. Pat. No. 5,059,699); derivatives in which an acyl chain is attached to enhance the taxane's lipid solubility (see e.g. U.S. Pat. No. 6,482,850); trihydrate forms of docetaxel that exhibit greater stability than the anhydrous product (see e.g. U.S. Pat. No. 6,022,985 and 6,838,569); C-10 taxane derivatives, including those containing a carbamate moiety at the C-10 position (U.S. Pat. No. 8,138,361); hydrophobic taxane derivatives (U.S. Patent Publication No. US20090263483); and hydrazide containing carboxylate derivatives of taxanes (see e.g. U.S. Pat. No. 8,133,888).

b. Tumor- or Stromal-Targeted Taxanes

The taxane compounds provided in the compositions and combinations herein are generally prepared to target the tumor or stroma surrounding a tumor. The taxane in the compositions and combinations provided herein are also provided as solubilized or nanodispersed formulations that exhibit improved solubility.

The natural or semi-synthetically produced paclitaxel (taxol) suffers from problems such as low water solubility and non-specific targeting or localization. For example, taxanes, including paclitaxel and docetaxel, are very poorly water soluble (less than 10 μg/mL), and as a result, cannot be practically formulated with an aqueous medium for intravenous administration. To combat the water solubility problems, current formulations of paclitaxel are formulated for intravenous administration to patients with cancer in a solution with polyoxyethylated castor oil (Polyoxyl 35 or Cremophor®) as the primary solvent/surfactant, with high concentrations of ethanol employed as co-solvent. Like paclitaxel, docetaxel is very poorly soluble in water. Currently, the solvent/surfactant used to dissolve docetaxel is polysorbate 80 (Tween 80) (Bissery et al. 1991 Cancer Res. 51(18):4845-52; Tomiak et al. 1994). The ethanol, Cremophor and/or Tween in the existing formulations are associated with the occurrence of hypersensitivity reactions, which can include severe skin rashes, hives, flushing, dyspnea, tachycardia and others.

Further, by increasing the specificity toward a cancer tissue, the taxane molecules exhibit less toxicity due to reduced systemic effects or exposure. Typically, a tumor-targeted taxane is a taxane, derivative, analog or prodrug thereof that is conjugated or linked directly or indirectly via a linker to a tumor recognition moiety. The tumor recognition moiety can be a monoclonal antibody, protein, peptide, lipid or macromolecular complex that recognizes a tumor-specific marker or moiety differentially expressed on cancer cells compared to normal cells. Cancer cells overexpress many tumor-specific markers or receptors that can be targeted to deliver a taxane.

The tumor-targeted taxane can be provided as micelles, nanoparticles, microspheres, liposomes or hydrogel formulations. Such formulations can be used in order to encapsulate active ingredients such as taxanes that can exhibit low solubility in aqueous medium. Such formulations are well-known to one of skill in the art. In some examples, the delivery vehicle is coated or conjugated with the tumor-targeting moiety, such as a macromolecular complex, monoclonal antibody, protein, peptide of lipid. Hence, in some examples, the drug delivery platform encapsulates the taxane, and itself displays a targeting ligand or other polymeric coating on the surface to effect tumor targeting.

Exemplary tumor-targeted taxanes and formulations thereof, contain a tumor targeting moiety that is a macromolecule such poly-L-glutamate (PGA-TXL, Xyotax; Li et al. (1998) Cancer Res., 58:2404-2409); a monoclonal antibody specific against a tumor marker, such as p140 TrkA or p75 receptors (Guillemard and Saragovi (2001) Cancer Res., 61:694) or anti-epidermal growth factor receptor (i.e. anti-EGFR monoclonal antibody, such as cetuximab; Safavy et al. (2003) Bioconjug., 14:302-10; Ojima et al. (2002) J. Med. Chem., 45:5620-3), anti-HER2 (Herceptin, trastuzumab, Cirstoiu-Hapca et al. (2010) J. Control Release, 144:324-31); a polyunsaturated fatty acid such as docosahexaenoic acid (DHA; Bradley et al. (2001) Clin. Cancer Research, 7:3229-38), linolenic acid or linoleic acid (Kuznetsova et al. (2006) Bioorg. Med. Chem. Lett., 15:974-7); a peptide such as a 7-amino acid synthetic peptide designated BBN[7-13] that binds to the cell surface bombesin/gastrin-releasing peptide (BBN/GRP) (Safavy et al. (1999) J. Med. Chem., 42:4919-4924), an LRP-1 targeted 19 amino acid peptide angiopep-2 (Wen et al. (2011) Molecular Cancer Therapeutics, 10 (11 Suppl):Abstract B49), an octapeptide that is cleaved by matrix metalloprotease 2 (MMP2; Yamada et al. (2010) Cancer Biology and Therapy, 9:192-203), an RGD peptide (see e.g. Zhao et al. (2009) J. Drug Target, 17:10-8); proteins that target tumor-specific receptors such as vitamin receptors, including biotin (vitamin H or B-7, folate or folic acid, vitamin B12 or riboflavin (see e.g. Chen et al. (2010) Biconjug. Chem., 21:979-987, Li et al. (2011) International Journal of Nanomedicine, 6:1167-1184); hyaluronic acid (HA) (Auzenne et al. (2007) Neoplasia, 9:479-486); transferrin (Sahoo et al. (2004) Int. J. Cancer, 112:335-40); and albumin.

Albumin-Bound Taxane

Exemplary of a soluble polymer-drug complex is an albumin-conjugated taxane. Albumin is a natural carrier of endogenous hydrophobic molecules, such as vitamins or hormones. In addition to acting as a carrier, albumin also facilitates endothelial transcytosis of protein-bound plasma constituents by binding to gp60 on the surface of endothelial cells, which effects caveolae-mediated transcytosis. Albumin also is able to bind to secreted protein acid rich in cysteine (SPARC, also known as osteonectin), which is present on many tumor cells. Hence, albumin promotes tumor cell accumulation of albumin-bound drugs.

Albumin includes human serum albumin (HSA) as well as non-human albumin such as bovine serum albumin (BSA). HSA is a highly soluble globular protein of $M_r$ 65K and contains 585 amino acids (SEQ ID NO:211). HSA is the most abundant protein in the plasma and accounts for 70-80% of the colloid osmotic pressure of human plasma. The amino acid sequence of HSA contains a total of 17 disulphide bridges, one free thiol (Cys 34), and a single tryptophan (Trp 214).

Human serum albumin (HSA) has multiple hydrophobic binding sites (a total of eight for fatty acids, an endogenous ligand of HSA) and has been shown to bind a diverse set of pharmaceutical agents, especially neutral and negatively charged hydrophobic compounds (Goodman et al., The Pharmacological Basis of Therapeutics, $9^{th}$ ed., McGraw-Hill New York (1996)). Two high affinity binding sites have been proposed in subdomains IIA and IIIA of HSA, which are highly elongated hydrophobic pockets with charged lysine and arginine residues near the surface which function as attachment points for polar ligand features (see, e.g., Fehske et al., Biochem. Pharmcol., 30, 687-92 (1981), Vorum, Dan. Med. Bull., 46, 379-99(1999), Kragh-Hansen, Dan. Med. Bull., 37:57- 84 (1990), Curry et al., Nat. Struct. Biol., 5, 827-35 (1998), Sugio et al., Protein. Eng., 12, 439-46 (1999), He et al., Nature, 358, 209-15 (1992), and Carter et al., Adv. Protein. Chem., 45, 153-203 (1994)). Paclitaxel and docetaxel have been shown to bind HSA (see, e.g., Paal et al., Eur. I Biochem., 268(7), 2187-91(2001), Purcell et al., Biochim. Biophys. Acta, 1478(1), 61-8 (2000), Altmayer et al., Arzneimittelforschung, 45, 1053-6 (1995), Garrido et al., Rev. Esp. Anestestiol. Reanim., 41, 308-12 (1994); and Urien et al., Invest. New Drugs, 14(2), 147-51 (1996)).

The weight ratio of albumin to taxane in the composition is about or less than 20:1 or less, such as 19:1, 18:1, 17:1, 16:1, 15:1, 14:1, 13:1, 12:1, 11:1, 10:1, 9:1, 8:1, 7:1, 6:1, 5:1 or less, and generally is at least or about at least or is 9:1. The resulting product can be generated to be free of solvent and/or surfactant. The taxane is coated with the albumin. The taxane/albumin nanoparticles generally have an average diameter of no greater than 200 nm, and generally 100 nm to 200 nm, such as an average diameter of 130 nm.

For example, albumin-bound taxanes include albumin-bound (nab-)paclitaxel (e.g. Abraxane, American Bioscience, Inc. (Santa Monica, Calif.); also described in U.S. Pat. Nos. 5,439,686 and 6,749,868) or albumin-bound-docetaxel (e.g. described in, for example, U.S. Pat. application Pub. Nos. 20080161382, 20070117744 and 20070082838). Human albumin functions as a surface-active polymer providing charge and steric stabilization to the paclitaxel nanoparticles to prevent aggregation. Stabilization is achieved by the fact that albumin adsorbs onto the surface of the paclitaxel nanoparticles, thus creating a sheet that functions as a surface-active polymer preventing aggregation of paclitaxel particles. The interaction between paclitaxel and human albumin is weak and both substances freely dissociate after reconstitution. Thus, when reconstituted and injected into the bloodstream, the paclitaxel concentration decreases rapidly and the albumin particles are believed to disassociate into individual albumin molecules and then circulate with the paclitaxel still attached. In particular, albumin-bound paclitaxel (e.g. nab-paclitaxel or Abraxane) can be used as a colloidal suspension derived from a lyophilized formulation of paclitaxel and human serum albumin diluted in saline solution (0.9% NaCl). The resulting drug particle complex is stabilized at an average size of 130 nm. Nanoparticles containing other taxanes, such as any described herein above, also can be generated and used, and can contain the same characteristics as described above.

3. Further Chemotherapeutic Agent (e.g. Nucleoside Analog)

Optionally, an additional chemotherapeutic agent whose activity is improved or increased by co-administration with one or both of a polymer-conjugated hyaluronan-degrading enzyme and/or a taxane formulation can be included in the combination therapy provided herein. For example, one or more nucleoside analogs, in particular anti-metabolites, can be included in the combination therapy provided herein. After they enter the cell, nucleoside analogs are successively phosphorylated to nucleoside 5'-mono-phosphates, di-phosphates and tri-phosphates. For example, generally, nucleoside analogs are converted to an active compound by phosphorylation of the nucleoside to its triphosphate (e.g. by diphosphate kinases), which then is able to compete with a physiologic nucleoside (e.g. dCTP) as a substrate for incorporation into DNA. Hence, nucleoside analogs mimic physiologic nucleosides. Once incorporated, the analog is an inefficient substrate, thereby stalling replication and/or causing chain termination. See Sampath et al. (2003), Oncogene, 22:9063-9074 for a review of nucleoside analogs. Since nucleoside analogs require conversion into an active form, they are generally prodrugs that must be phosphorylated to an active form.

Nucleoside analogs for use in the compositions and combinations herein include purine and pyrimidine nucleoside analogs, as well as derivatives and prodrug forms thereof. Pyrimidine nucleoside analogs include, but are not limited to, fluoropyrimidine 5-fluorouracil (5-FU; fluorouracil), 5-fluoro-2'-deoxycytidine (FCdR), arabinosylcytosine (ara-C; also called cytosine arabinoside or cytarabine), gemcitabine (2'-deoxy-2',2'-difluorocytidine), troxacitabine (beta-L-dioxolane cytidine, BCH-4556), decitabine (5-aza-2'-deoxycytidine), Azacytidine (4-amino-1-β-D-ribofuranosyl-1,3,5-triazin-2(1H)-one), pseudoisocytidine (psi ICR),5-aza-2'-deoxy-2',2'-difluorocytidine; 5-aza-2'-deoxy-2'-fluorocytidine; 1-β-D-ribofuranosyl-2(1H)-pyrimidinone (Zebularine); 2',3'-dideoxy-5-fluoro-3'-thiacytidine (Emtriva); 2'-cyclocytidine (Ancitabine); 1-β-D-arabinofuranosyl-5-azacytosine (Fazarabine or ara-AC); 6-azacytidine (6-aza-CR); 5,6-dihydro-5-azacytidine (dH-aza-CR); $N^4$-pentyloxycarbonyl-5'-deoxy-5-fluorocytidine (Capecitabine); $N^4$-octadecyl-cytarabine; and elaidic acid cytarabine, and derivatives and prodrug forms thereof. Purine nucleoside analogs include, for example, fludarabine, cladribine, clofarabine, nelarabine, forodesine, pentostatin and tezacitabine, and derivatives and prodrug forms.

Other prodrug forms of nucleoside analogs are known or can be generated. For example, other prodrug forms include those that are modified to alter properties of cellular uptake and/or resistance to deactivation by deaminase (discussed below). For example, such prodrug forms can permit improved oral absorption and/or increased or specific tissue targeting (Li et al. (2008) *Journal Pharm. Science,* 97:1109-1134).

The antitumor activity of some nucleoside analogs has been limited by the low cytotoxic levels that can be achieved. This is largely due to inactivation of the enzymes that can occur in many tissues. For example, metabolic inactivation of some nucleoside analogs can be caused by deamination. Deamination can be catalyzed by a nucleotide-specific deaminase, such as adenosine deaminase or cytidine deaminase (cdA). Thus, some cancer drugs are metabolized by an organism's naturally occurring enzymes such as adenosine deaminase (ADA, EC 3.5.4.4) and cytidine deaminase (CDA, also termed cytosine nucleoside deaminase, cytidine aminohydrolase, or EC 3.5.4.5). These enzymes function to deaminate natural aminopurine and aminopyrimidine nucleosides, respectively, in human and other organisms. These enzymes also convert active nucleoside-based cancer drugs into inactive metabolites. For example, CDA is a component of the pyrimidine salvage pathway. It converts cytidine and deoxycytidine to uridine and deoxyuridine, respectively, by hydrolytic deamination (Cacciamani et al. (1991) *Arch. Biochem. Biophys.* 290:285-292; Wentworth and Wolfenden (1978) *Methods Enzymol.* 57:401-407; Wisdom and Orsi (1967) *Biochem. J.* 104:7 P). It also deaminates a number of synthetic cytosine analogs which are clinically useful drugs, such as ara-C and others as discussed below (Eliopoulos et al. (1998) *Cancer Chemother. Pharmacol.* 42:373-378; Kees et al. (1989) *Cancer Res.* 49:3015-3019; *Antiviral Chem. Chemother.* (1990) 1:255-262). For example, the half-life of gemcitabine in plasma is approximately 10 minutes, due to rapid deamination by the endogenous enzyme deoxycytidine deaminase to the corresponding uracil derivative (dFdU) (P. G. Johnston et al., Cancer Chromatography and Biological Response Modifiers, Annual 16, 1996, Chap. 1, ed. Pinedo H. M. et al.).

For example, the purine nucleoside drug arabinosyladenine (fludarabine, ara-A) is deaminated by ADA; the resulting compound, with the parent amino group replaced with hydroxyl, is inactive as an antitumor agent compared to the parent compound. Similarly, the drug arabinosylcytosine (also termed cytarabine Ara-C (or AraC); 4-Amino-1-(β-D-arabinofuranosyl)-2(1H)-pyrimidinone; Cytosine arabinoside; or 1-(β-D-Arabinofuranosylcytosine) is metabolically degraded by CDA into inactive arabinosyluracil. Gemcitabine, decitabine, azacytidine and others are also similarly inactivated. The deamination of nucleoside analogs, such as cytosine nucleosides and their analogs (e.g. cytarabine and gemcitabine), prevents the accumulation of their toxic intracellular triphosphate derivatives that act as the active metabolites.

Conversion of the cytosine compounds to the uridine derivatives usually confers loss of therapeutic activity or addition of side-effects. It has also been shown that cancers that acquire resistance to cytosine analog drugs often overexpress CDA (*Leuk. Res.* 1990, 14, 751-754). Leukemic cells and solid tumors expressing a high level of CDA can manifest resistance to cytosine antimetabolites and thereby limit the antineoplastic activity of such therapeutics (*Biochem. Pharmacol.* 1993, 45:1857-1861). Resistance to nucleoside analogs can require increased dosages, continued infusions or repeat administrations. These effects can lead to serious adverse effects, especially related to myelosuppression and immunosuppression.

Reactive oxygen species (ROS) are associated with the inactivation of enzymes, including nucleoside deaminases. Taxanes are known to induce intratumoral ROS, and thus can inactivate the activity of nucleoside deaminases (see e.g. Frese et al. (2012) *Cancer Discovery,* 2:260-269).

Hence, for purposes herein, exemplary nucleoside analogs for use in the combinations and compositions provided herein are those that are substrates for a deaminase, and that thereby are inactivated. For example, the deaminase can be a cytidine deaminase or an adenosine deaminase. The intratumoral level and activity of such analogs can be greatly increased in combination therapy with a polymer-conjugated hyaluronan degrading enzyme and a taxane formulation. Exemplary of such nucleoside analogs include, but are not limited to, fludarabine, cytarabine, gemcitabine, decitabine and azacytidine or derivatives thereof. In particular examples, the nucleoside analog is one that can treat solid tumors, such as bladder, breast, lung, ovarian, pancreatic and other cancers.

Any of the nucleoside analogs provided herein can be formulated as liposomes, microparticles, nanoparticles, or as polymer-conjugates. For example, formulations can be prepared in order to control delivery and/or increase half-lives of the administered drugs. For example, exemplary liposomal formulations are known (see e.g. U.S. Pat. Nos. 5,736,155 and 8,022,279).

Exemplary Nucleoside Analogs i) Gemcitabine

Gemcitabine (2',2'-difluorodeoxycytidine, dFdC) is a difluorinated analog of deoxycytidine and thus is a nucleoside analog or an antimetabolite. After it enters cells, intracellular phosphorylation by nucleoside monophosphate and diphosphate kinases produces 5'-diphosphate (dFdCDP) and 5'-triphosphate (dFdCTP) derivatives, respectively. Gemcitabine triphosphate acts as a fraudulent base, competing with dCTP for incorporation into DNA. If incorporated into DNA, only one more nucleotide can be incorporated before DNA chain elongation is halted. DNA polymerase epsilon is then unable to remove the gemcitabine nucleotide and repair the growing DNA strands (masked chain termination).

Gemcitabine is marketed as Gemzar®, which is a lyophilized powder formulation. Gemzar®, gemcitabine for injection, USP, contains Gemcitabine HCl that is 2'-deoxy-2',2'-difluorocytidine monohydrochloride (β-isomer). Gemzar® is supplied as an intravenous formulation containing either 200 mg or 1 g of gemcitabine HCl (expressed as free base) formulated with mannitol (200 mg or 1 g, respectively) and sodium acetate (12.5 mg or 62.5 mg, respectively) as a sterile lyophilized powder. pH of the formulation can be adjusted by addition of hydrochloric acid and/or sodium hydroxide. Gemzar®, a process for making it and methods for using it are described in U.S. Pat. Nos. 5,464,826 and 4,808,614. Gemzar® is currently approved for the treatment of pancreatic cancer, breast cancer and non-small cell lung cancer (NSCLC) and is being evaluated for ovarian cancer. In addition Gemzar® can be used in the treatment of HCV as well as a modulator of immune function (see U.S. Pat. No. 6,555,518). Gemzar® can be administered by intravenous infusion at a dose of approximately 1000 to 1250 mg/m$^2$ over 30 minutes, once weekly for up to 7 weeks followed by a week of rest from treatment.

Synthetic derivatives of gemcitabine, including several prodrug forms, are known see for example, Ishitsuka et al, International Publication No. WO03/043631; Alexander et al. (2003) *J. Med. Chem.,* 46: 4205-4208; U.S. Pat. No. 6,303,569; Guo et al. (2001) *Cancer Chemother. Pharmacol.,*48:169-176; International Publication No. WO01/21135; Di Stefano et al. (1999) *Biochem. Pharmacol.,* 57: 793-799; Guo et al. (1999) *J. Org. Chem.,* 64: 8319-8322; International Publication No. WO99/33483; International Publication No. WO98/32762; International Publication No. WO98/00173; U.S. Pat. Nos. 5,606,048; 5,594,124; European Patent Application No. EP712860; U.S. Pat. Nos. 5,521,294; 5,426,183; 5,401,838; European Patent No. EP0376518; European Patent Application No. EP577303; European Patent Application No. EP576230; Chou et al. (1992) *Synthesis,* 565-570; Richardson et al. (1992) *Nucleic Acid Res.,* 20: 1763-1768; Baker et al. (1991) *J Med. Chem.,* 34: 1879-1884; International Publication No. WO91/15498; European Patent Application No. EP329348; European Patent Application No. EP272891).

Exemplary improved prodrugs include, but are not limited to, gemcitabine elaidate (also termed 9(E)-Octadecenoic acid 2'-deoxy-2',2'-difluorocytidin-5'-yl ester; 2'-Deoxy-2', 2'-difluoro-5'-O-[9(E)-octadecenoyl]cytidine; CP-4126; or CAS Registry no. 210829-30-4); Azelaic acid gemcitabine ester meglumine salt (also termed 1-[5-O-(9-Carboxynonanoyl)-β-D-arabinofuranosyl]cytosine meglumine salt); other salts of Azelaic acid gemcitabine ester; and 1-[4-(2-Propylpentanamido)-2-oxo-1H-pyrimidin-1-yl]-2-deoxy-2,2-difluoro-β-D-ribofuranose (also termed LY-2334737). For example, CP-4126 is a lipophilic, unsaturated fatty acid ester derivative of gemcitabine. Due to its lipophilicity, it exhibits an increased cellular uptake and accumulation, thereby resulting in an increased conversion to active metabolites.

Compared to other nucleoside analogs, gemcitabine and derivatives or prodrugs thereof, exhibits greater antitumor activity, particularly towards solid tumors. Antitumor activity of gemcitabine has been demonstrated against cancers, of the pancreas, small-cell and non-small cell lung cancer, and bladder cancer.

A relatively hydrophilic compound, gemcitabine has limited ability to permeate plasma membranes via passive diffusion. Thus, increased dosages or infusions are required. Gemcitabine administration has been associated with some side effects. The administered dosages or longer infusion times to maintain cytotoxic levels can be associated with myelotoxicity, and other adverse effects such as elevated liver transaminase enzyme, nausea and vomiting and skin rash.

ii) Cytarabine

Cytarabine is a nucleoside analog that was originally isolated from the sponge *Cryptotethya crypta.* Cytarabine is phosphorylated to ara-CTP, which can compete with dCTP. ara-CTP also can become incorporated into the DNA and interfere with chain polymerization and DNA repair. Cytarabine can be inactivated by cytidine deaminase.

Cytarabine has been principally used in hematological cancers. Synthetic derivatives of cytarabine have been developed and shown to exhibit efficacy against solid tumors. These include, for example, gemcitabine (see above). For example, ester derivatives of cytarabine are known. Exemplary of such a derivative is CP-4055, which is the 5'-elaidic acid ester of cytarabine (see e.g. Breistol et al. (1999) *Cancer Res.,* 59:2944).

Due to the problems maintaining sufficient levels of cytotoxic effects, the administered dosages or increased infusion times can cause side effects such as myelosuppression and other specific tissue injuries.

iii) Decitabine

Decitabine (5-aza-2'-deoxycytidine, 5-aza-CdR) is a pyrimidine nucleoside analog of cytidine. Decitabine was initially prepared by cyclization of peracylglycosyl isocyanates (Pliml and Sorm (1964) *Collect. Czech. Chem. Commun.* 29:2576-2577). Two isomeric forms of decitabine can be distinguished. The β-anomer is the active form. Decitabine is the active ingredient in the commercially marketed DACOGEN™ product, in the form of a sterile lyophilized powder for injection.

Inside the cell, decitabine is first converted into its active form, the phosphorylated 5-aza-deoxycytidine, by deoxycytidine kinase which is primarily synthesized during the S phase of the cell cycle. The affinity of decitabine for the catalytic site of deoxycytidine kinase is similar to the natural substrate, deoxycytidine (Momparler et al. (1985) *Pharmacol Ther* 30:287-299). After conversion to its triphosphate form by deoxycytidine kinase, decitabine is incorporated into replicating DNA at a rate similar to that of the natural substrate, dCTP (Bouchard and Momparler (1983) *Mol. Pharmacol.* 24:109-114).

One of the functions of decitabine is its ability to specifically and potently inhibit DNA methylation. Methylation of cytosine to 5-methylcytosine occurs at the level of DNA. Incorporation of decitabine into the DNA strand has a hypomethylation effect. Each class of differentiated cells has its own distinct methylation pattern. After chromosomal duplication, in order to conserve this pattern of methylation, the 5-methylcytosine on the parental strand serves to direct methylation on the complementary daughter DNA strand. Substituting the carbon at the 5 position of the cytosine for a nitrogen interferes with this normal process of DNA methylation. The replacement of 5-methylcytosine with decitabine at a specific site of methylation produces an irreversible inactivation of DNA methyltransferase, presumably due to formation of a covalent bond between the enzyme and decitabine (Juttermann et al. (1994) *Proc. Natl. Acad. Sci. USA* 91:11797-11801). By specifically inhibiting DNA methyltransferase, the enzyme required for methylation, the aberrant methylation of the tumor suppressor genes can be prevented.

Methods of preparing decitabine, and particularly the (β-anomer, are known in the art (see e.g. U.S. Pat. Nos. 3,350,388; 3,817,980; 4,209,613; U.S. published Appl. No. US20120046457; International Appl. Publ. No. WO2008/101448; Winkley et al. (1970) *J Org Chem,* 35:491-495; Piskala et al. (1978) *Nucleic Acids Research,* 1:s109-s 114; Ben-Hattar et al. (1986) *J Org Chem,* 51:3211-3213.) Decitabine can be formulated by standard methods known in the art. The formulations can be liquid or lyophilized formulations. For example, decitabine is commonly supplied as a sterile lyophilized powder for injection, together with buffering salt, such as potassium dihydrogen phosphate, and pH modifier, such as sodium hydroxide. For example, decitabine is supplied by SuperGen, Inc., as lyophilized powder packed in 20 mL glass vials, containing 50 mg of decitabine, monobasic potassium dihydrogen phosphate, and sodium hydroxide. When reconstituted with 10 mL of sterile water for injection, each mL contain 5 mg of decitabine, 6.8 mg of $KH_2PO_4$, and approximately 1.1 mg NaOH. The pH of the resulting solution is 6.5-7.5. The reconstituted solution can be further diluted to a concentration of 1.0 or 0.1 mg/mL in cold infusion fluids, i.e., 0.9% Sodium Chloride; or 5% Dextrose; or 5% Glucose; or Lactated Ringer's. The unopened vials are typically stored under refrigeration (2-8° C.; 36-46° F.), in the original package. Liquid formulations also are known (see e.g. U.S. Pat. No. 6,982,253).

Decitabine exhibits a short half-life in vivo because of the deamination of decitabine to 5-aza-2'-deoxyuridine, which is catalyzed by cytidine deaminase (Chabot et al. (1983) *Biochemical Pharmacology* 22:1327-1328). The estimated $K_m$ of decitabine was 250 µM for the enzyme purified from human liver as compared to the $K_m$ of 12 µM for the natural substrate, deoxycytidine. The rate of deamination of deoxycytidine was about 6-fold greater than that of decitabine by cytidine deaminase at equal concentrations. Due to the short half-life, decitabine is most typically administrated to patients by injection, such as by a bolus I.V. injection, continuous I.V. infusion, or I.V. infusion.

The length of I.V. infusion can be limited by the decomposition of decitabine in aqueous solutions. Derivatives of decitabine exist that are more stable in aqueous solutions (see e.g. U.S. Pat. No. 7,250,416).

iv) Azacytidine 5-azacytidine (National Service Center designation NSC-102816; CAS Registry Number 320-67-2), also known as azacitidine, AZA, or 4-amino-1- β-D-ribofuranosyl-1,3,5-triazin-2(1H)-one, is an analog of decitabine (see e.g. Hanna et al. (1998) *Collect. Czech. Chem. Commun.,* 63:222-230). It is currently marketed as the drug product VIDAZA®. Azacytidine is a nucleoside analog, more specifically a cytidine analog. It is an antagonist of its natural nucleoside. For example, the only structural difference between azacytosine and cytosine is the presence of a nitrogen atom at position 5 of the cytosine ring in azacytosine as compared to a carbon at this position for cytosine.

Methods of preparing azacytidine, and particularly methods that avoid the use of water, are known in the art (U.S. Pat. Nos. 3,350,388; 8,058,424; Winkley and Robins (1970) *J. Org. Chem.,* 35:491; Piskala and Sorm (1978) *Nucl. Acid Chem.,* 1:435; and Vorbrueggen et al. (1981) *Chemische Berichte,* 114:1234-1255.

Azacytidine is a substrate for cytidine deaminase (see e.g. Voytek et al. (1977) *Cancer Res.,* 37:1956-61). In order to exhibit cytotoxic effects in vivo high concentrations or continuous infusions are required. Side effects include decreased white and red blood cell and platelet count, nausea, vomiting, fatigue, diarrhea, among other effects.

D. Methods Of Producing Nucleic Acids And Encoded Polypeptides Of Hyaluronan Degrading Enzymes Polypeptides of a hyaluronan degrading enzyme, such as a soluble hyaluronidase, set forth herein, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a hyaluronidase, such as from a cell or tissue source. Modified or variant soluble hyaluronidases, can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any hyaluronan degrading enzyme polypeptide described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the hyaluronan degrading enzyme polypeptide, in some examples a soluble hyaluronidase polypeptide, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. Cell 22:787-797(1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983); see also "Useful Proteins from Recombinant Bacteria": in Scientific American 242:79-94 (1980); plant expression vectors containing the nopaline synthetase promoter (Herrera-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538(1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (Novagen, Madison, Wis.), which contain a His-Tag™ leader sequence for use in purification with a H is column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Expression

Hyaluronan degrading enzyme polypeptides, including soluble hyaluronidase polypeptides, can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Hyaluronan degrading enzyme polypeptides, such as soluble hyaluronidase polypeptides, also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a his$_6$ tag or a myc tag, or a tag for purification, for example, a GST fusion, and a sequence for directing protein secretion and/or membrane association.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility.

Additionally, proteins expressed in yeast can be directed for secretion using secretion signal peptide fusions such as the yeast mating type alpha-factor secretion signal from *Saccharomyces* cerevisae and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including hyaluronan degrading enzyme polypeptides, such as soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene. control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NSO (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO—S cells (Invitrogen, Carlsbad, Calif., cat #11619-012) and the serum free EBNA-1 cell line (Pham et al., (2003) *Biotechnol. Bioeng.* 84:332-342). Cell lines also are available that are adapted to grow in special media optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

3. Purification Techniques

Method for purification of polypeptides, including hyaluronan degrading enzyme polypeptides (e.g. soluble hyaluronidase polypeptides) or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as soluble hyaluronidase polypeptides, can be purified using standard protein purification techniques known in the art including but not limited to, SDS-PAGE, size fraction and size exclusion chromatography, ammonium sulfate precipitation and ionic exchange chromatography, such as anion exchange chromatography. Affinity purification techniques also can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or His$_6$ and affinity purified with myc antibody, glutathione resin and Ni-resin, respectively. Purity can be assessed by any method known in the art including gel electrophoresis and staining and spectrophotometric techniques. Purified rHuPH20 compositions, as provided herein, typically have a specific activity of at least 70,000 to 100,000 Units/mg, for example, about 120,000 Units/mg. The specific activity can vary upon modification, such as with a polymer.

4. PEGylation of Hyaluronan Degrading Enzyme Polypeptides

Polyethylene glycol (PEG) has been widely used in biomaterials, biotechnology and medicine primarily because PEG is a biocompatible, nontoxic, water-soluble polymer that is typically nonimmunogenic (Zhao and Harris, *ACS Symposium Series* 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, Adv. Drug Del. Rev. 16:157-82, 1995). Similarly, PEG has been attached to low molecular weight, relatively hydrophobic drugs to enhance solubility, reduce toxicity and alter biodistribution. Typically, PEGylated drugs are injected as solutions.

A closely related application is synthesis of crosslinked degradable PEG networks or formulations for use in drug delivery since much of the same chemistry used in design of degradable, soluble drug carriers can also be used in design of degradable gels (Sawhney et al., *Macromolecules* 26: 581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., *Eur. Polym J.* 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from both homopolymers and copolymers.

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., Bioconjugate Chem. 6:62-69, 1995; Veronese et al., J. Bioactive Compatible Polymers 12:197-207, 1997; U.S. Pat. Nos. 5,672,662; 5,932,462; 6,495,659; 6,737,505; 4,002,531; 4,179,337; 5,122,614; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO0500360; U.S. 2005/0114037; U.S. 2005/0171328; U.S. 2005/0209416; EP 1064951; EP 0822199; WO 01076640; WO 0002017; WO 0249673; WO 9428024; and WO 0187925).

In one example, the polyethylene glycol has a molecular weight ranging from about 3 kD to about 50 kD, and typically from about 5 kD to about 30 kD. Covalent attachment of the PEG to the drug (known as "PEGylation") can be accomplished by known chemical synthesis techniques. For example, the PEGylation of protein can be accomplished by reacting NHS-activated PEG with the protein under suitable reaction conditions.

While numerous reactions have been described for PEGylation, those that are most generally applicable confer directionality, utilize mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatised PEG more susceptible to nucleophilic attack. The attacking nucleophile is usually the epsilon-amino group of a lysyl residue, but other amines also can react (e.g. the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan degrading enzyme and reduced in the presence of NaCNBH$_3$. More specifically, PEGylated CMP sugars can be reacted with a hyaluronan degrading enzyme in the presence of appropriate glycosyl-transferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e. pharmaceuticals) the typical potential immune response is an IgG and/or IgM response, while polypeptides which are inhaled through the respiratory system (i.e. industrial polypeptide) potentially can cause an IgE response (i.e. allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated hyaluronan degrading enzymes provided herein, including the PEGylated hyaluronidases, PEG moieties are conjugated, via covalent attachment, to the polypeptides. Techniques for PEGylation include, but are not limited to, specialized linkers and coupling chemistries (see e.g., Roberts et al., Adv. Drug Deliv. Rev. 54:459-476, 2002), attachment of multiple PEG moieties to a single conjugation site (such as via use of branched PEGs; see e.g., Guiotto et al., Bioorg. Med. Chem. Lett. 12:177-180, 2002), site-specific PEGylation and/or mono-PEGylation (see e.g., Chapman et al., Nature Biotech. 17:780-783, 1999), and site-directed enzymatic PEGylation (see e.g., Sato, Adv. Drug Deliv. Rev., 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

As an exemplary illustration of the PEGylation of an illustrative method for making PEGylated hyaluronan degrading enzymes, such as PEGylated hyaluronidases, PEG aldehydes, succinimides and carbonates have each been applied to conjugate PEG moieties, typically succinimidyl PEGs, to rHuPH20. For example, rHuPH20 has been conjugated with exemplary succinimidyl monoPEG (mPEG) reagents including mPEG-Succinimidyl Propionates (mPEG-SPA), mPEG-Succinimidyl Butanoates (mPEG-SBA), and (for attaching "branched" PEGs) mPEG2-N-Hydroxylsuccinimide. These PEGylated succinimidyl esters contain different length carbon backbones between the PEG group and the activated cross-linker, and either a single or branched PEG group. These differences can be used, for example, to provide for different reaction kinetics and to potentially restrict sites available for PEG attachment to rHuPH20 during the conjugation process.

Succinimidyl PEGs (as above) comprising either linear or branched PEGs can be conjugated to rHuPH20. PEGs can used to generate rHuPH20s reproducibly containing molecules having, on the average, between about three to six or three to six PEG molecules per hyaluronidase. Such PEGylated rHuPH20 compositions can be readily purified to yield compositions having specific activities of approximately 25,000 or 30,000 Unit/mg protein hyaluronidase activity, and being substantially free of non-PEGylated rHuPH20 (less than 5% non-PEGylated).

Using various PEG reagents, exemplary versions of hyaluronan degrading enzymes, in particular soluble human recombinant hyaluronidases (e.g. rHuPH20), can be prepared, for example, using mPEG-SBA (30 kD), mPEG-SMB (30 kD), and branched versions based on mPEG2-NHS (40(kD) and mPEG2-NHS (60 kD). PEGylated versions of rHuPH20 have been generated using NHS chemistries, as well as carbonates, and aldehydes, using each of the following reagents: mPEG2-NHS-40K branched, mPEG-NHS-10K branched, mPEG-NHS-20K branched, mPEG2-NHS-60K branched; mPEG-SBA-5K, mPEG-SBA-20K, mPEG-SBA-30K; mPEG-SMB-20K, mPEG-SMB-30K; mPEG-butyraldehyde; mPEG-SPA-20K, mPEG-SPA-30K; and PEG-NHS-5K-biotin. PEGylated hyaluronidases have also been prepared using PEG reagents available from Dowpharma, a division of Dow Chemical Corporation; including hyaluronidases PEGylated with Dowpharma's p-nitrophenyl-carbonate PEG (30 kDa) and with propionaldehyde PEG (30 kDa).

In one example, the PEGylation includes conjugation of mPEG-SBA, for example, mPEG-SBA-30K (having a molecular weight of about 30 kDa) or another succinimidyl esters of PEG butanoic acid derivative, to a soluble hyaluronidase. Succinimidyl esters of PEG butanoic acid derivatives, such as mPEG-SBA-30K readily couple to amino groups of proteins. For example, covalent conjugation of m-PEG-SBA-30K and rHuPH20 (which is approximately 60 KDa in size) provides stable amide bonds between rHuPH20 and mPEG, as shown in Scheme 1, below.

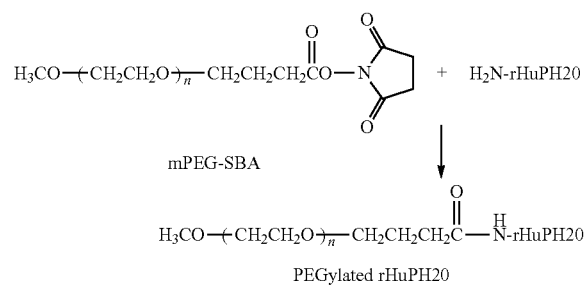

Scheme 1

Typically, the mPEG-SBA-30K or other PEG is added to the hyaluronan degrading enzyme, in some instances a hyaluronidase, at a PEG:polypeptide molar ratio of 10:1 in a suitable buffer, e.g. 130 mM NaCl/10 mM HEPES at pH 6.8 or 70 mM phosphate buffer, pH 7, followed by sterilization, e.g. sterile filtration, and continued conjugation, for example, with stirring, overnight at 4° C. in a cold room. In one example, the conjugated PEG-hyaluronan degrading enzyme is concentrated and buffer-exchanged.

Other methods of coupling succinimidyl esters of PEG butanoic acid derivatives, such as mPEG-SBA-30K are known in the art (see e.g., U.S. Pat. Nos. 5,672,662; 6,737,505; and U.S. 2004/0235734). For example, a polypeptide, such as a hyaluronan degrading enzyme (e.g. a hyaluronidase), can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration. Another method reacts polypeptide with mPEG-SBA in deionized water to which triethylamine is added to raise the pH to 7.2-9. The resulting mixture is stirred at room temperature for several hours to complete the PEGylation.

Methods for PEGylation of hyaluronan degrading polypeptides, including, for example, animal-derived hyaluronidases and bacterial hyaluronan degrading enzymes, are known to one of skill in the art. See, for example, European Patent No. EP 0400472, which describes the PEGylation of bovine testes hyaluorindase and chondroitin ABC lyase. Also, U.S. Publication No. 20060104968 describes PEGylation of a human hyaluronidase derived from human PH20. For example, the PEGylated hyaluronan-degrading enzyme generally contains at least 3 PEG moieties per molecule. For example, the hyaluronan-degrading enzyme can have a PEG to protein molar ratio between 5:1 and 9:1, for example, 7:1.

E. Pharmaceutical Compositions and Formulations

Provided herein are compositions or combinations of an anti-hyaluronan agent and a tumor-targeted taxane formulation. For example, provided herein are compositions or combinations of a polymer-conjugated hyaluronan-degrading enzyme and a tumor-targeted taxane formulation. The taxane formulation can be co-formulated or co-administered with compositions containing an anti-hyaluronan agent, such as a hyaluronan-degrading enzyme. For example, such combinations and compositions can be used in the treat of cancers, including solid tumors, as described herein. In some examples, the anti-hyaluronan agent, such as a hyaluronan-degrading enzyme, can be provided as a combination of separate compositions that are administered separately. In other examples, the anti-hyaluronan agent, e.g., hyaluronan-dgrading enzyme, and taxane are provided in the same composition and can be administered together. The compositions or combination of compositions can be formulated for parenteral delivery (i.e. for systemic delivery). For example, the compositions or combination of compositions are formulated for subcutaneous delivery or for intravenous delivery.

Also provided herein are combinations and compositions containing a third agent that is a further chemotherapeutic agent for treating cancer, such as a nucleoside analog or other antimetabolite (e.g. gemcitabine or derivative or other nucleoside analog). Exemplary of such agents are described above and elsewhere herein. The further chemotherapeutic agent, for example a nucleoside analog, can be co-formulated or co-administered with compositions containing an anti-hyaluronan agent, such as a hyaluronan-degrading enzyme, and/or compositions containing a tumor-targeted taxane. For example, the further chemotherapeutic agent, for example a nucleoside analog, can be provided as a separate composition from the combinations or compositions of an anti-hyaluronan agent, e.g., hyaluronan-degrading enzyme, and taxane. In other examples, the nucleoside analog is co-formulated with one or both of the anti-hyaluronan agent, for example, the hyaluronan-degrading enzyme, and taxane. For example, the nucleoside analog is co-formulated with a anti-hyaluronan agent, such as a hyaluronan-degrading enzyme, and a tumor-targeted taxane is provided as a separate composition. In another example, the nucleoside analog is co-formulated with a tumor-targeted taxane and an anti-hyaluronan agent, for example, hyaluronan-degrading enzyme, is provided as a separate composition. As a further example, the nucleoside analog, anti-hyaluronan agent and tumor-targeted taxane are co-formulated together in the same composition. The compositions or combination of compositions can be formulated for parenteral delivery (i.e. for systemic delivery). For example, the compositions or combination of compositions are formulated for subcutaneous delivery or for intravenous delivery.

The compositions can be formulated for single dosage administration or for multiple dosage administration. The agents can be formulated for direct administration. The compositions can be provided as a liquid or lyophilized formulation.

The compounds can be formulated into suitable pharmaceutical preparations such as solutions, suspensions, tablets, dispersible tablets, pills, capsules, powders, sustained release formulations or elixirs, for oral administrate, as well as transdermal patch preparation and dry powder inhalers. Typically, the compounds are formulated into pharmaceutical compositions using techniques and procedures well known in the art (see e.g., Ansel *Introduction to Pharmaceutical Dosage Forms*, Fourth Edition, 1985, 126). Generally, the mode of formulation is a function of the route of administration. The compositions can be co-formulated or provided as separate compositions.

Generally, the compositions are formulated in lyophilized or liquid form. Where the compositions are provided in lyophilized form they can be reconstituted just prior to use by an appropriate buffer, for example, a sterile saline solution. The compositions can be provided together or separately. For purposes herein, such compositions typically are provided separately. The anti-hyaluronan agent, for example, the hyaluronan degrading enzyme, such as soluble hyaluronidase, tumor-targeted taxane and/or a further chemotherapeutic agent can be packaged as separate compositions for administration together, sequentially or intermittently. The combinations can be packaged as a kit.

Compositions can be formulated for administration by any route known to those of skill in the art including intramuscular, intravenous, intradermal, intralesional, intraperitoneal injection, subcutaneous, intratumoral, epidural, nasal, oral, vaginal, rectal, topical, local, otic, inhalational, buccal (e.g., sublingual), and transdermal administration or any route. Other modes of administration also are contemplated. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the nature of the disease, the progress of the disease, the severity of the disease and the particular composition which is used. For purposes herein, it is desired that an anti-hyaluronan agent, typically a hyaluronan degrading enzyme, such as a soluble hyaluronidase, tumor-targeted taxane and/or further chemotherapeutic agent are administered such that a pharmaceutically available amount or level exists in the plasma. For example, compositions are administered sytemically, for example, via intravenous administration. Subutaneous methods also can be employed, although increased absorption times can be necessary to ensure equivalent bioavailability compared to intravenous methods. The agents, such as a hyaluronan degrading enzyme, tumor-targeted taxane, and/or a further chemotherapeutic agent (e.g. nucleoside analog) can be administered by different routes of administration. Pharmaceutical compositions can be formulated in dosage forms appropriate for each route of administration.

Administration methods can be employed to decrease the exposure of hyaluronan degrading enzymes, e.g. soluble hyaluronidases, and other molecules to degradative processes, such as proteolytic degradation and immunological intervention via antigenic and immunogenic responses. Examples of such methods include local administration at the site of treatment or continuous infusion of the anti-hyaluronic agent.

1. Formulations

Pharmaceutically acceptable compositions are prepared in view of approvals for a regulatory agency or other agency prepared in accordance with generally recognized pharmacopeia for use in animals and in humans. Compositions can take the form of solutions, suspensions, emulsion, tablets, pills, capsules, powders, and sustained release formulations. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. The formulation should suit the mode of administration.

Pharmaceutical compositions can include carriers such as a diluent, adjuvant, excipient, or vehicle with which an enzyme or activator is administered. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrin derivatives, sorbitan monolaurate, triethanolamine sodium acetate, triethanolamine oleate, and other such agents.

In one example, pharmaceutical preparation can be in liquid form, for example, solutions, syrups or suspensions. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Pharmaceutically and therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Unit dosage forms, include, but are not limited to, tablets, capsules, pills, powders, granules, sterile parenteral solutions or suspensions, and oral solutions or suspensions, and oil water emulsions containing suitable quantities of the compounds or pharmaceutically acceptable derivatives thereof. Unit dose forms can be contained ampoules and syringes or individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of .005% to 100% with the balance made up from non-toxic carrier can be prepared.

Pharmaceutical composition can be formulated in dosage forms appropriate for each route of administration.

a. Injectables, Solutions and Emulsions

Parenteral administration, generally characterized by injection, either subcutaneously, intramuscularly, intratumorally, intravenously or intradermally is contemplated herein. Injectables can be prepared in conventional forms, either as liquid solutions or suspensions, solid forms suitable for solution or suspension in liquid prior to injection, or as emulsions. Suitable excipients are, for example, water, saline, dextrose, glycerol or ethanol. In addition, if desired, the pharmaceutical compositions to be administered may also contain an activator in the form of a solvent such as pH buffering agents, metal ion salts, or other such buffers. The pharmaceutical compositions also may contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins. Implantation of a slow-release or sustained-release system, such that a constant level of dosage is maintained (see, e.g., U.S. Pat. No. 3,710,795) also is contemplated herein. The percentage of active compound contained in such parenteral compositions is highly dependent on the specific nature thereof, as well as the activity of the compound and the needs of the subject.

For example, a standard stabilized formulation of a polymer-conjugated hyaluronan-degrading enzyme, such as a polymer-conjugated soluble hyaluronidase as provided herein, is formulated with one or more of EDTA, NaCl, $CaCl_2$, histidine, lactose, albumin, Pluronic® F68, TWEEN® and/or other detergent or other similar agents. For example, compositions provided herein can contain one or more pH buffers (such as, for example, histidine, phosphate, or other buffers), or acidic buffer (such as acetate, citrate, pyruvate, Gly-HCl, succinate, lactate, maleate or other buffers), tonicity modifier (such as, for example, an amino acid, polyalcohol, NaCl, trehalose, other salts and/or sugars), stabilizer, chelating agent, such as ethylenediaminetetraacetic acid, ethylenediaminetetraacetate or calcium EDTA, oxygen scavenger, such as methionine, ascorbic acid/ascorbate, citric acid/citrate, or albumin, and/or a preservative, such as preservative containing an aromatic ring (e.g. phenol or cresol). Exemplary stabilizers that are useful for compositions containing a hyaluronan degrading enzyme include detergents, such as polysorbates and proteins such as human serum albumin. Exemplary concentrations of serum albumin that are useful in the compositions herein include 0.1 mg/mL to 1 mg/mL, such as at least or at least about or about 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL or 1 mg/mL, but can be more or less.

Polysorbates also can be present in the compositions at, for example, concentrations of or about between 0.001% to 0.1%, such as at least about or at least or about or 0.001%, 0.002%, 0.003%, 0.004%, 0.005%, 0.006%, 00.007%, 0.008%, 0.009%, 0.01%, 0.02%, 0.03%, 0.04%, 0.05%, 0.06%, 0.07%, 0.08%, 0.09% or 0.1%. A metal chelating agent, such as calcium EDTA (CaEDTA), also can be present, such as for example, at concentrations of between approximately 0.02 mM to 20 mM, such as at least about or at least or about or 0.02 mM, 0.04 mM, 0.06 mM, 0.08 mM, 0.1 mM, 0.2 mM, 0.3 mM, 0.4 mM, 0.5 mM, 0.6 mM, 0.7 mM, 0.8 mM, 0.9 mM, 1 mM, 5 mM, 10 mM, 15 mM, 20 mM or more. The pH and the osmolarity of the compositions can be adjusted by one of skill in the art to optimize the conditions for the desired activity and stability of the composition. In some examples, the compositions provided herein have an osmolarity of between 100 mOsm/kg to 500 mOsm/kg, such as at least or at least about or at or about 100 mOsm/kg, 120 mOsm/kg, 140 mOsm/kg, 160 mOsm/kg, 180 mOsm/kg, 200 mOsm/kg, 220 mOsm/kg, 240 mOsm/kg, 260 mOsm/kg, 280 mOsm/kg, 300 mOsm/kg, 320 mOsm/kg, 340 mOsm/kg, 360 mOsm/kg, 380 mOsm/kg, 400 mOsm/kg, 420 mOsm/kg, 440 mOsm/kg, 460 mOsm/kg, 500 or more mOsm/kg, and a pH of between or between about 6 to 8, such as 6 to 7.4, for example at or about 6, 6.2, 6.4, 6.6, 6.8, 7, 7.2, 7.4, 7.6, 7.8 or 8.

Generally, NaCl is provided in formulations containing a hyaluronan-degrading enzyme herein, for example, in an amount that is or is about 100 mM to 150 mM or more. For example, an exemplary formulation can contain at or about 10 mM histidine and/or at or about 130 mM NaCl. Other formulations can contain in addition or alternatively lactose, for example, at or about 13 mg/ml. Additionally, an anti-bacterial or anti-fungal agent, including, but not limited to thiomersal, can be present in the formulation. Formulations can further contain Albumin, Pluronic® F68, TWEEN® and/or other detergent. The formulations are provided at a pH that is or is about 6.0 to 7.4, such as 6.0, 6.1, 6.2, 6.3, 6.4, 6.5, 6.6, 6.7, 6.8, 6.9, 7.0, 7.1, 7.2, 7.3 or 7.4, generally that is or is about pH 6.5. Concentrated formulations of a modified soluble hyaluronidase for use herein are generally diluted in a saline solution or other salt buffered solution prior administration to maintain the appropriate salt concentration.

Injectables are designed for local and systemic administration. For purposes herein, local administration is desired for direct administration to the affected interstitium associated with accumulated or excess hyaluronan. Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous. If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcelluose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

If administered intravenously, suitable carriers include physiological saline or phosphate buffered saline (PBS), and solutions containing thickening and solubilizing agents, such as glucose, polyethylene glycol, and polypropylene glycol and mixtures thereof.

The concentration of the pharmaceutically active compound is adjusted so that an injection provides an effective amount to produce the desired pharmacological effect. The exact dose depends on the age, weight and condition of the patient or animal as is known in the art. The unit-dose parenteral preparations are packaged in an ampoule, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

b. Lyophilized Powders

Of interest herein are lyophilized powders, which can be reconstituted for administration as solutions, emulsions and other mixtures. They may also be reconstituted and formulated as solids or gels. The lyophilized powders can be prepared from any of the solutions described above.

The sterile, lyophilized powder is prepared by dissolving a compound of an anti-hyaluronan agent that is a hyaluronan-degrading enzyme, such as a soluble hyaluronidase, and/or second agent in a buffer solution. The buffer solution may contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbitol, fructose, corn syrup, xylitol, glycerin, glucose, sucrose or other suitable agent, in a suitable buffer, such as citrate, sodium or potassium phosphate or other such buffer known to those of skill in the art. Then, a selected enzyme is added to the resulting mixture, and stirred until it dissolves. The resulting mixture is sterile filtered or treated to remove particulates and to insure sterility, and apportioned into vials for lyophilization. Each vial will contain a single dosage (1 mg -1 g, generally 1-100 mg, such as 1-5 mg) or multiple dosages of the compound. The lyophilized powder can be stored under appropriate conditions, such as at about 4° C. to room temperature.

Reconstitution of this lyophilized powder with a buffer solution provides a formulation for use in parenteral administration. The precise amount depends upon the indication treated and selected compound. Such amount can be empirically determined.

c. Topical Administration

Topical mixtures are prepared as described for the local and systemic administration. The resulting mixture may be a solution, suspension, emulsions or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compounds or pharmaceutically acceptable derivatives thereof may be formulated as aerosols for topical application, such as by inhalation (see, e.g., U.S. Pat. Nos. 4,044,126, 4,414,209, and 4,364,923, which describe aerosols for delivery of a steroid useful for treatment inflammatory diseases, particularly asthma). These formulations for administration to the respiratory tract can be in the form of an aerosol or solution for a nebulizer, or as a microfine powder for insufflation, alone or in combination with an inert carrier such as lactose. In such a case, the particles of the formulation will typically diameters of less than 50 microns, preferably less than 10 microns.

The compounds may be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in optionally buffered aqueous solution of, for example, 0.1 to 0.2 M concentration with respect to the active compound. Formulations suitable for transdermal administration also can be delivered by iontophoresis (see, e.g., *Pharmaceutical Research* 3(6), 318 (1986)) and typically take the form of an optionally buffered aqueous solution of the active compound.

d. Compositions for Other Routes of Administration

Depending upon the condition treated other routes of administration, such as topical application, transdermal patches, oral and rectal administration, also are contemplated herein. For example, pharmaceutical dosage forms for rectal administration are rectal suppositories, capsules and tablets for systemic effect. Rectal suppositories include solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases may be used. Agents to raise the melting point of suppositories include spermaceti and wax. Rectal suppositories may be prepared either by the compressed method or by molding. The typical weight of a rectal suppository is about 2 to 3 gm. Tablets and capsules for rectal administration are manufactured using the same pharmaceutically acceptable substance and by the same methods as for formulations for oral administration.

Formulations suitable for rectal administration can be provided as unit dose suppositories. These can be prepared by admixing the active compound with one or more conventional solid carriers, for example, cocoa butter, and then shaping the resulting mixture.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Pharmaceutical compositions also can be administered by controlled release formulations and/or delivery devices (see, e.g., in U.S. Pat. Nos. 3,536,809; 3,598,123; 3,630,200; 3,845,770; 3,847,770; 3,916,899; 4,008,719; 4,687,660; 4,769,027; 5,059,595; 5,073,543; 5,120,548; 5,354,556; 5,591,767; 5,639,476; 5,674,533 and 5,733,566).

Various delivery systems are known and can be used to administer selected compositions, such as but not limited to, encapsulation in liposomes, microparticles, microcapsules, recombinant cells capable of expressing the compound, receptor mediated endocytosis, and delivery of nucleic acid molecules encoding a soluble hyaluronidase or other agent such as retrovirus delivery systems.

Hence, in certain embodiments, liposomes and/or nanoparticles also can be employed with administration of compositions herein. Liposomes are formed from phospholipids that are dispersed in an aqueous medium and spontaneously form multilamellar concentric bilayer vesicles (also termed multilamellar vesicles (MLVs)). MLVs generally have diameters of from 25 nm to 4 µm. Sonication of MLVs results in the formation of small unilamellar vesicles (SUVs) with diameters in the range of 200 to 500 angstroms containing an aqueous solution in the core.

Phospholipids can form a variety of structures other than liposomes when dispersed in water, depending on the molar ratio of lipid to water. At low ratios, the liposomes form. Physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

Liposomes interact with cells via different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. Varying the liposome formulation can alter which mechanism is operative, although more than one can operate at the same time. Nanocapsules can generally entrap compounds in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use herein, and such particles can be easily made.

2. Formulation Amounts

The compositions can be formulated for single dosage administration or for multiple dosage administration. The agents can be formulated for direct administration.

In the compositions or combinations of compositions provided herein wherein the anti-hyaluronan agent is a hyaluronan-degrading enzyme such as a polymer-conjugated hyaluronan-degrading enzyme, the polymer-conjugated hyaluronan-degrading enzyme is formulated in an amount for direct administration in a range between or about between 0.5 µg to 50 mg, such as 100 µg to 1 mg, 1 mg to 20 mg, 100 µg to 5 mg, 0.5 µg to 1450 µg, 1 µg to 1000 µg, 5 µg to 1250 µg, 10 µg to 750 µg, 50 µg to 500 µg, 0.5 µg to 500 µg or 500 µg to 1450 µg. For example, the polymer-conjugated hyaluronan-degrading enzyme is formulated in an amount for direct administration in a range between or about between 15 Units (U) or 150 Units (U) to 60,000 Units per dose, 300 U to 30,000 U, 500 U to 25,000 U, 500 U to 10,000 U, 150 U to 15,000 U, 150 U to 5000 U, 500 U to 1000 U, 5000 U to 45,000 U 10,000 U to 50,000 U or 20,000 U to 60,000 U, for example at least or about at least or about or 15 U, 50 U, 100 U, 200 U, 300 U; 400 U; 500 U; 600 U; 700 U; 800 U; 900 U; 1,000 U; 1250 U; 1500 U; 2000 U; 3000 U; 4000 U; 5,000 U; 6,000 U; 7,000 U; 8,000 U; 9,000 U; 10,000 U; 20,000 U; 30,000 U; 40,000 U; or 50,000 U. The polymer-conjugated hyaluronan-degrading enzyme can be provided as a stock solution at or about 50 U/mL to 15,000 U/mL, such as 10 U/mL to 500 U/mL, 1000 U/mL to 15,000 U/mL, 100 U/mL to 5,000 U/mL, 500 U/mL to 5,000 U/mL or 100 U/mL to 400 U/mL, for example at least or at least about or about or 50 U/mL, 100 U/mL, 150 U/mL, 200 U/mL, 400 U/mL, 500 U/mL, 1000 U/mL, 2000 Units/mL, 3000 U/mL, 4000 U/mL, 5000 U/mL, 6000 U/mL, 7000 U/mL, 8000 U/mL, 9000 U/mL, 10,000 U/mL, 11,000 U/mL, 12,000 U/mL, or 12,800 U/mL. The volume of the composition can be 0.5 mL to 1000 mL, such as 0.5 mL to 100 mL, 0.5 mL to 10 mL, 1 mL to 500 mL, 1 mL to 10 mL, such as at least or about at least or about or 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL or more. The composition is generally formulated so that the polymer-conjugated hyaluronan-degrading enzyme is not administered in volumes greater than about 50 mL, and typically is administered in a volume of 5-30 mL, generally in a volume that is not greater than about 10 mL. For larger volumes, the time of infusion can be adapted to facilitate delivery of the larger volume. For example, infusion time can be at least 1 minute, 5 minutes, 10 minutes, 20 minutes, 30 minutes, 40 minutes, 50 minutes, 1 hour or more.

In the compositions or combinations of compositions provided herein, the tumor-targeted taxane, such as an albumin-bound taxane, for example albumin-bound paclitaxel, is formulated in an amount for direct administration of the taxane in a range between or about between 10 mg to 1000 mg, such as 20 mg to 500 mg, 10 mg to 250 mg, 75 mg to 400 mg, 100 mg to 200 mg, 150 mg to 400 mg, 200 mg to 800 mg, 50 mg to 200 mg or 50 mg to 150 mg. The composition can be provided as a lyophilized form for later reconstitution or as a liquid formulation. For example, reconstitution of a liquid formulation can be with water or 0.9% sodium chloride or other physiological solution. When reconstituted or provided as a liquid formulation, the composition can be provided containing taxane in the tumor-targeted taxane formulation as a stock solution of between or about between 0.01 mg/mL to 100 mg/mL, such as 1 mg/mL to 50 mg/ml, 2.5 mg/mL to 25 mg/mL, 5 mg/mL to 15 mg/mL or 10 mg/mL to 100 mg/mL, for example at least or about at least 5 mg/mL. The volume of the composition can be 0.5 mL to 1000 mL, such as 0.5 mL to 100 mL, 0.5 mL to 10 mL, 1 mL to 500 mL, 1 mL to 10 mL, such as at least or about at least or about or 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL, 100 mL, 200 mL or more. The entire vial contents can be withdrawn for administration, or can be divided up into a plurality of dosages for mutliple administration. For larger volumes, the time of infusion can be adapted to facilitate delivery of the larger volume. For example, infusion time can be at least 1 minute, 5 minutes, 10 minutes, 20 minutes, 30 minutes, 40 minutes, 50 minutes, 1 hour or more. It is understood that formulations of a taxane can contain other components, including carriers, polymers, lipids and other excipients. The dosages provided above are with respect to the taxane component, which is the active ingredient.

For example, Abraxane®, an albumin-bound paclitaxel, is formulated as a solvent-free formulation of paclitaxel in which paclitaxel is complexed only with albumin to form stable particles or about 130 nm in size. Each 50 mL vial of Abraxane® contains 100 mg of paclitaxel and approximately 900 mg of human albumin as a sterile, lyophilized cake. Each vial is provided to be reconstituted with 20 mL of 0.9% Sodium Chloride Injection, USP to produce a suspension containing 5 mg/mL of paclitaxel. Reconstituted Abraxane suspension is infused at a recommended dose of 260 mg/m$^2$ intravenously over 30 minutes.

In the compositions or combinations of compositions provided herein, the nucleoside analog, such as gemcitabine or a derivative thereof, is formulated in an amount for direct administration in a range between or about between 100 mg to 5000 mg, such as 500 mg to 5000 mg, 500 mg to 2500 mg, 1000 mg to 2500 mg, 2000 mg to 5000 mg or 1500 mg to 2500 mg, generally at least or about at least or about 100 mg, 200 mg, 300 mg, 400 mg, 500 mg, 600 mg, 700 mg, 800 mg, 900 mg or 1000 mg. The composition can be provided as a lyophilized form for later reconstitution or as a liquid formulation. For example, reconstitution of a liquid formulation can be with water or 0.9% sodium chloride or other physiological solution. When reconstituted or provided as a liquid formulation, the composition can be provided as a stock solution containing a nucleoside analog of between or about between 1 mg/mL to 500 mg/mL, such as 5 mg/mL to 100 mg/ml, 10 mg/mL to 50 mg/mL, 25 mg/mL to 200 mg/mL or 20 mg/mL to 100 mg/mL, for example at least or about at least 5 mg/mL, 10 mg/mL, 20 mg/mL, 30 mg/mL or 40 mg/mL, and generally not greater than 40 mg/mL in order to minimize incomplete dissolution. The volume of the composition can be 0.5 mL to 1000 mL, such as 0.5 mL to 100 mL, 0.5 mL to 10 mL, 1 mL to 500 mL, 1 mL to 10 mL, such as at least or about at least or about or 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL, 100 mL, 200 mL or more. The entire vial contents can be withdrawn for administration, or can be divided up into a plurality of dosages for multiple administration. For larger volumes, the time of infusion can be adapted to facilitate delivery of the larger volume. For example, infusion time can be at least 1 minute, 5 minutes, 10 minutes, 20 minutes, 30 minutes, 40 minutes, 50 minutes, 1 hour or more. Upon withdrawal of an amount of drug for administration, the formulation can be further diluted if desired, such as diluted in water, saline (e.g. 0.9%) or other physiological solution. It is understood that formulations of a nucleoside analog (e.g. gemcitabine or a derivative) can contain other components, including carriers, polymers, lipids and other excipients. The dosages provided above are with respect to the nucleoside analog component, which is the active ingredient.

For example, Gemzar®, gemictabine for injection, is provided as a lyophilized formulation containing 200 mg or 1000 mg active agent per vial. Each vial is provided to be reconstituted with 5 mL or 25 mL, respectively, of 0.9% Sodium Chloride Injection, USP to produce a suspension containing 40 mg/mL of gemcitabine (accounting for the displacement volume of the lyophilized powder the reconstituted concentration can be about or 38 mg/mL). Prior to administration, the appropriate amount of drug can be further diluted with 0.9% sodium chloride or other physiological solution.

3. Packaging and Articles of Manufacture

Also provided are articles of manufacture containing packaging materials, any pharmaceutical composition or combination provided herein, and a label that indicates that the compositions and combinations are to be used for treatment of cancers, such as stromal tumor cancers or solid tumor cancers. Exemplary of articles of manufacture are containers including single chamber and dual chamber containers. The containers include, but are not limited to, tubes, bottles and syringes. The containers can further include a needle for subcutaneous administration.

In one example, the article of manufacture contains a pharmaceutical composition contains the anti-hyaluronan agent, such as the polymer-conjugated hyaluronan-degrading enzyme, and tumor-targeted taxane and no further agent or treatment. In another example, the article of manufacture contains pharmaceutical compositions containing the anti-hyaluronan agent, e.g., polymer-conjugated hyaluronan-degrading enzyme, the tumor-targeted taxane and a further chemotherapeutic agent (e.g. nucleoside analog). In this example, the agents can be provided together or separately, for packaging as articles of manufacture.

The articles of manufacture provided herein contain packaging materials. Packaging materials for use in packaging pharmaceutical products are well known to those of skill in the art. See, for example, U.S. Pat. Nos. 5,323,907, 5,052, 558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment.

The choice of package depends on the agents, and whether such compositions will be packaged together or separately. In general, the packaging is non-reactive with the compositions contained therein. In other examples, some of the components can be packaged as a mixture. In other examples, all components are packaged separately. Thus, for example, the components can be packaged as separate compositions that, upon mixing just prior to administration, can be directly administered together. Alternatively, the components can be packaged as separate compositions for administration separately.

The components can be packaged in a container. The components are separately packaged in the same container. Generally, examples of such containers include those that have an enclosed, defined space that contains the polymer-conjugated hyaluronan-degrading enzyme, and a separate enclosed, defined space containing the other components or component such that the subsequent areas are separated by a readily removable membrane which, upon removal, permits the components to mix, or which permits the components to be separately administered. Any container or other article of manufacture is contemplated, so long as the agents are separated from the other components prior to administration. For suitable embodiments see e.g., containers described in U.S. Pat. Nos. 3,539,794 and 5,171,081.

Selected compositions including articles of manufacture thereof also can be provided as kits. Kits can include a pharmaceutical composition described herein and an item for administration provided as an article of manufacture. The kit can, optionally, include instructions for application including dosages, dosing regimens and instructions for modes of administration. Kits also can include a pharmaceutical composition described herein and an item for diagnosis.

F. Methods of Assessing Activity, Bioavailability and Pharmacokinetics

The agents in the compositions herein can be assessed for properties and activities. The properties and activities can be related to biological activities and/or tumorgenic activities. The assays can be performed in vitro or in vivo. Such assays can include, but are not limited to, measuring amounts of hyaluronan in tissue or tumor biopsies or soluble hyaluronan in plasma, measurements of hyaluronan catabolites in blood or urine, measurements of hyaluronidase activity in plasma, or measurements of interstitial fluid pressure, vascular volume or water content in tumors. The assays can be used to assess effects of agents, including effects of dose and route of administration.

1. In Vitro Assays a. Hyaluronidase Activity of a Hyaluronan Degrading Enzyme

The activity of a hyaluronan degrading enzyme can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbididy assay. This is based on the formation of an insoluble precipitate when hyaluronic acid binds with serum albumin. The activity is measured by incubating hyaluronidase with sodium hyaluronate (hyaluronic acid) for a set period of time (e.g., 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity. In another example, hyaluronidase activity is measured using a microtiter assay in which residual biotinylated hyaluronic acid is measured following incubation with hyaluronidase (see e.g. Frost and Stern (1997) Anal. Biochem. 251:263-269, U.S. Pat. Pub. No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g. Delpech et al., (1995) Anal. Biochem. 229:35-41; Takahashi et al., (2003) Anal. Biochem. 322:257-263).

The ability of a hyaluronan degrading enzyme, such as a modified soluble hyaluronidase (eg PEGylated rHuPH20) to act as a spreading or diffusing agent also can be assessed. For example, trypan blue dye can be injected, such as subcutaneously or intradermally, with or without a hyaluronan degrading enzyme into the lateral skin on each side of nude mice. The dye area is then measured, such as with a microcaliper, to determine the ability of the hyaluronan degrading enzyme to act as a spreading agent (see e.g. U.S. Published Patent No. 20060104968). The effect of co-administration of a hyaluronan degrading enzyme, such as a hyaluronidase, with another agent, such as a chemotherapeutic, on the pharmacokinetic and pharmacodynamic properties of that agent also can be assessed in vivo using animal model and/or human subjects, such as in the setting of a clinical trial, as discussed above and demonstrated in Example 1, below. The functional activity of a hyaluronan degrading enzyme that is not a hyaluronidase can be compared to a hyaluronidase using any of these assays. This can be done to determine what a functionally equivalent amount of a hyaluronan degrading enzyme is. For example, the ability of a hyaluronan degrading enzyme to act as a spreading or diffusing agent can be assessed by injecting it (e.g. subcutaneously or intradermally) into the lateral skin of mice with trypan blue, and the amount required to achieve the same amount of diffusion as, for example, 100 units of a Hyaluronidase Reference Standard, can be determined. The amount of hyaluronan degrading enzyme required is, therefore, functionally equivalent to 100 hyaluronidase units. The hydraulic conductivity (K), such as in a tumor, before and after treatment with a modified hyaluronan degrading enzyme, such as a modified hyaluronidase, also can be measured to assess the activity of a modified hyaluronan degrading enzyme preparation.

The ability of a modified hyaluronan degrading enzyme, such as a modified hyaluronidase, including pegylated hyaluronidase, to affect any one or more of the markers associated with hyaluronan-associated diseases and disorders described above, or any other associated markers or phenotypes, can be assessed using any one or more of the assays described above. For example, the ability of a modified hyaluronan degrading enzyme, such as a modified hyaluronidase, to reduce hyaluronan levels or content, formation or size of halos, interstitial fluid pressure, water content and/or vascular volume can be assessed using any one or more of the assays above in vitro, ex vivo and/or in vivo. In one example, a modified hyaluronidase can be administered to a subject with a tumor or an appropriate animal model and the effect on hyaluronan levels, formation or size of halos, interstitial fluid pressure, water content and/or vascular volume assessed and compared to subjects or animal models not administered modified hyaluronidase. In some examples, the modified hyaluronidase can be administered with another agent, such as a chemotherapeutic agent.

Other assays various assays to assess hyaluronidase activity, including effects on HA synthesis or degradation, are known to one of skill in the art, including but not limited to any described herein or known in the art, for example, in vitro assays that measure hyaluronan degradation (see e.g., Frost and Stern (1997) *Anal. Biochem.* 251:263-269), staining tissue or other samples for HA such as by using an HA-binding protein or other anti-HA reagent (see e.g., Nishida et al. (1999) *J. Biol. Chem.,* 274:21893-21899), particle exclusion assay (Nishida et al. 1999; Morohashi et al. (2006) *Biochem Biophys. Res. Comm.,* 345:1454-1459); measuring or assessing HAS mRNA expression for an has gene (Nishida et al. 1999).

b. Taxane Activity

Standard physiological, pharmacological and biochemical procedures are available for testing the compounds to identify those that possess a desired biological activity for inhibiting tubulin association. In vitro and in vivo assays can be used to evaluate biolocial activity, such as cytotoxicity and tubulin polymerization (see e.g., Hidaka et al. (2012) *Biosci. Biotechnol. Biochem.,* 76:349-352).

For example, the taxane compounds provided herein can be tested in a microtubule stabilization assay (Barron et al., (2003) *Anal. Biochem.,* 315:49-56). Tubulin assembly or inhibition thereof can be monitored in a tubulin polymerization assay in an absorbance or fluorescence format. For example, an optical density based tubulin polymerization assay can be used, since the concentration of a microtubule polymer is proportional to the extent of light that is scattered by microtubules. Exemplary of such an assay is the Tubulin polymerization HTS Assay (Catalog No. BK004P or BK006P; Cytoskeleton, Denver, Colo.). A fluorescence-based assay also can be used, whereby polymerization is followed by fluoroescence enhancement due to the incorporation of a fluorescent reporter into microtubules (Catalog No. BK011P, Cytoskeleton, Denver). In such assays, tubulin can be incubated with a taxane compound, such as paclitaxel, vinblastine or doceletaxel, and polymerization can be measured over time. For example, in a fluoroescence assay, polymerization can be measured by monitoring changes in fluorescence at excitation at 360 nm and emission at 420 nm. Tubulin assembly can also be monitored by light scattering, which is approximated by the apparent absorption at 350 nm. In the assay, bovine serum albumin (BSA) is generally employed to prevent aggregation. Also, glycerol, which is a tubulin polymerization enhancer, is omitted to increase the signal to noise ratio. As a control, the microtubule destabilizing drug, vinblastine, can be used, which stabilizes tubulin and does not effect depolymerization.

c. Anticancer Activity

Anticancer activity of the compounds and agents described herein, including hyaluronan-degrading enzyme, tumor-taxane targeted and/or other chemotherapeutic agenet (e.g. nucleoside analog) and formulations thereof can be examined in vitro, for example, by incubating a cancer cell culture with the derivative, and then evaluating cell growth inhibition in the culture. Suitable cells for such testing include murine P388 leukemia, B16 melanoma and Lewis lung cancer cells, as well as human mammary $MCF_7$, ovarian OVCAR-3, A549 lung cancer cells, MX-1 (human breast tumor cell), HT29 (colon cancer cell line), HepG2 (liver cancer cell lines), and HCT 116 (colon cancer cell lines).

2. In Vivo Animal Models

Animal models can be used to assess the effects of compositions or combinations provided herein on hyaluronan levels or content, interstitial fluid pressure, water content, vascular volume, and on tumor size, volume or growth. In addition, animal models can be used to assess the pharmacokinetics or tolerability of the compositions or combinations.

Animal models can include, but are not limited to, mice, rats, rabbits, dogs, guinea pigs and non-human primate models, such as cynomolgus monkeys or rhesus macaques. Animal models including genetic models as well as xenograft models. For example, xenograft models include those in which, prior to testing the agents, tumors can be established in suitable test animals, e.g., nude mice. In some examples, immunodeficient mice, such as nude mice or SCID mice, are transplanted with a tumor cell line, such as from a hyaluronan-associated cancer, to establish an animal model of that cancer. Exemplary cell lines, including from hyaluronan-associated cancers, include, but are not limited to, PC3 prostate carcinoma cells, BxPC-3 pancreatic adenocarcinoma cells, MDA-MB-231 breast carcinoma cells, MCF-7 breast tumor cells, BT474 breast tumor cells, Tramp C2 prostate tumor cells and Mat-LyLu prostate cancer cells, and other cell lines described herein that are hyaluronan associated, e.g. contain elevated levels of hyaluronan. Exemplary of a animal tumor model of pancreatic cancer involves the generation of tumors in animals using BxPC-3 pancreatic adenocarcinoma cells (see e.g. Von Hoff et al. (2011) *J. Clin. Oncol.,* 29:4548-54).

Genetic models also can be used in which animals are rendered to be deficient in one or more genes that results in tumor generation or formation. Such genetically engineered mouse models (GEMM) can recapitulate the molecular and clinical features of disease. For example, an exemplary pancreatic cancer genetic model involves the pancreatic specific expression of endogenous mutants Kras and Trp53 alleles, which results in mutant mice that exhibit a deficient phenotype (termed KPC mice; LSL-Kras$^{G12D}$, LSL-Trp53$^{R172H}$, Pdx-1-Cre). The KPC mice develop primary pancreatic tumors that exhibit features similar to human disease, including resistance to the nucleoside analog gemcitabine (see e.g. Frese et al. (2012) *Cancer Discovery,* 2:260-269).

The compositions or combinations provided herein can be administered to the mice to assess effects on the disease. For example, hyaluronan levels can be assessed or measured. In another example, the effects on tumor growth or tumor cell inhibition can be assessed. For example, $ED_{50}$ values, that is, the amount of the agent(s) required to achieve 50% inhibition of tumor growth in the animal can be determined. Survival rates also can be determined.

3. Pharmacokinetics and Tolerability

Pharmacokinetic and tolerability studies can be performed using animal models or can be performed during clinical studies with patients to assess the effect of the combinations and compositions provided herein. Animal models include, but are not limited to, mice, rats, rabbits, dogs, guinea pigs and non-human primate models, such as cynomolgus monkeys or rhesus macaques. In some instances, pharmacokinetic and tolerability studies are performed using healthy animals. In other examples, the studies are performed using animal models of a disease for which therapy with a combination or composition herein is considered, such as animal models of cancer.

The pharmacokinetic properties of the combinations or compositions proided herein can be assessed by measuring such parameters as the maximum (peak) chemotherapeutic agent concentration ($C_{max}$), the peak time (i.e. when maximum chemotherapeutic agent concentration occurs; $T_{max}$), the minimum chemotherapeutic agent concentration (i.e. the minimum concentration between doses of chemotherapeutic agent; $C_{min}$), the elimination half-life ($T_{1/2}$) and area under the curve (i.e. the area under the curve generated by plotting time versus concentration; AUC), following administration. In instances where the chemotherapeutic agent is administered subcutaneously, the absolute bioavailability of the agent is determined by comparing the area under the curve of chemotherapeutic agent following subcutaneous delivery ($AUC_{sc}$) with the AUC of chemotherapeutic agent following intravenous delivery ($AUC_{iv}$). Absolute bioavailability (F), can be calculated using the formula: $F=([AUC]_{sc} \times dose_{sc})/([AUC]_{iv} \times dose_{iv})$. The concentration of chemotherapeutic agent in the plasma following subcutaneous administration can be measured using any method known in the art suitable for assessing concentrations of chemotherapeutic agent in samples of blood.

A range of doses and different dosing frequency of dosing can be administered in the pharmacokinetic studies to assess the effect of increasing or decreasing concentrations of the co-administered agent (e.g. nucleoside analog). Pharmacokinetic properties of subcutaneously administered chemotherapeutic, such as bioavailability, also can be assessed with or without co-administration of polymer-conjugated hyaluronan-degrading enzyme and/or tumor-targeted taxane. For example, dogs, such as beagles, can be administered a chemotherapeutic (e.g. nucleoside analog such as gemcitabine) in combination with polymer-conjugated hyaluronan-degrading enzyme and/or tumor-targeted taxane, or alone, using one or more routes of administration. Such studies can be performed to assess the effect of co-administration with an anti-hyaluronan agent, such as a hyaluronidase, on pharmacokinetic properties, such as bioavailability, of chemotherapeutic agents.

Studies to assess safety and tolerability also are known in the art and can be used herein. Following administration of a the combininion and compositions herein, the development of any adverse reactions can be monitored. Adverse reactions can include, but are not limited to, injection site reactions, such as edema or swelling, headache, fever, fatigue, chills, flushing, dizziness, urticaria, wheezing or chest tightness, nausea, vomiting, rigors, back pain, chest pain, muscle cramps, seizures or convulsions, changes in blood pressure and anaphylactic or severe hypersensitivity responses. Typically, a range of doses and different dosing frequencies are be administered in the safety and tolerability studies to assess the effect of increasing or decreasing concentrations of chemotherapeutic agent and/or anti-hyaluronan agent, such as a polymer-conjugated hyaluronan-degrading enzyme, and/or tumor-targeted taxane in the dose.

G. Methods and Uses of Combination Therapy

The combinations and compositions provided herein can be used in methods of therapy for treating cancers, and in particular solid tumor cancers. In the methods, a combination therapy of an anti-hyaluronan agent, such as a polymer-conjugated hyaluronan-degrading enzyme (e.g. a hyaluronidase, such as a PH20, for example PEGPH20) and a taxane formulation (e.g. an albumin-bound taxane formulation) is administered to a subject having a solid tumor. In some examples, a further nucleoside analog agent also can be administered, and in particular a nucleoside analog agent that is a treatment for solid tumors and/or is susceptible to inhibition by deamination (e.g. gemcitabine or derivative thereof). As found herein, the intratumoral amount of a nucleoside analog, and hence the cytotoxic effects thereof, in a combination regimen with a polymer-conjugated hyaluronan-degrading enzyme and a taxane formulation far exceeds the effects when the nucleoside analog is administered with only one of the agents (i.e. polymer-conjugated hyaluronan-degrading enzyme or taxane formulation). For example, the effects can be synergistic. The extent and level of nucleoside analog intratumoral activity observed in the combination therapy provided herein achieves results that have heretofore not been achieved with existing therapies, including increased efficacy and survival that surpasses existing treatment regimes.

1. Cancers

The combination therapy of an anti-hyaluronan agent, e.g. polymer-conjugated hyaluronan-degrading enzyme, taxane formulation and/or a nucleoside analog can be used for the treatment of cancerous cells, neoplasms, tumors and metastases. The combination therapy provided herein exhibits antitumor efficacy and results in a slowing or reduction of tumor growth, a decrease in tumor volume, and in some cases elimination or eradication of the tumor. The combination therapy results in increased survival of subjects compared to subjects treated with the same agents as a single or double combination therapy. For cancers like pancreatic cancer that are difficult to treat, the combination therapy provides significant benefits compared to existing methods.

For example, the combination therapy can be used to treat a solid tumor, such as of the lung and bronchus, breast, colon and rectum, kidney, stomach, esophagus, liver and intrahepatic bile duct, urinary bladder, brain and other nervous system, head and neck, oral cavity and pharynx, cervix, uterine corpus, thyroid, ovary, testes, prostate, malignant melanoma, cholangiocarcinoma, thymoma, non-melanoma skin cancers, as well as hematologic tumors and/or malignancies, such as childhood leukemia and lymphomas, multiple myeloma, Hodgkin's disease, lymphomas of lymphocytic and cutaneous origin, acute and chronic leukemia such as acute lymphoblastic, acute myelocytic or chronic myelocytic leukemia, plasma cell neoplasm, lymphoid neoplasm and cancers associated with AIDS. Typically, the combination therapy is used for the treatment of solid tumors, for example, solid tumor stromal cancers. Exemplary tumors include, for example, pancreatic tumors, ovarian tumors, lung tumors, colon tumors, prostate tumors, cervical tumors and breast tumors.

In particular, the cancers can be hyaluronan-rich cancers that are suited for targeting by an anti-hyaluronan agent, such as a hyaluronan-degrading enzyme. Several hyaluronan-rich cancers have been identified. Hyaluronan-rich tumors include, but are not limited to, prostate, breast, colon, ovarian, stomach, head and neck and other tumors and cancers. In some cases, hyaluronan levels correlate with poor prognosis, for example, decreased survival rate and/or recurrence-free survival rate, metastases, angiogenesis, cancer cell invasion into other tissues/areas, and other indicators of poor prognosis. Such correlation has been observed, for example, in hyaluronan-rich tumors including ovarian cancer, SCC, ISC, prostate cancer, lung cancer, including non-small-cell lung cancer (NSCLC), breast cancer, colon cancer and pancreatic cancer (see, for example, Anttila et al., (2000) *Cancer Research*, 60:150-155; Karvinen et al., (2003) *British Journal of Dermatology*, 148:86-94; Lipponen et al., (2001) *Eur. Journal of Cancer*, 849-856; Pirinen et al., (2001) *Int. J. Cancer:* 95: 12-17; Auvinen et al., (2000) *American Journal of Pathology*, 156(2):529-536; Ropponen et al., (1998) *Cancer Research*, 58: 342-347). Thus, hyaluronan-rich cancers can be treated by administration of an anti-hyaluronan agent, such as a hyaluronidase, to treat one or more symptoms of the cancer.

In examples of treating hyaluronan-rich cancers, the anti-hyaluronan agent, such as a hyaluronan-degrading enzyme, can act as a therapeutic by itself and/or it can enhance the activity of other co-administered or combination therapies. For example, hyaluronan-degrading enzymes, such as hyaluronidase, have direct anticarcinogenic effects when injected into tumors. Hyaluronidase prevents growth of tumors transplanted into mice (De Maeyer et al., (1992) *Int. J. Cancer* 51:657-660) and inhibits tumor formation upon exposure to carcinogens (Pawlowski et al. (1979) Int. *J. Cancer* 23:105-109) Hyaluronidase is effective as the sole therapeutic agent in the treatment of brain cancer (gliomas) (see, International Pat. Pub. No. WO198802261).

Anti-hyaluronan agents, such as hyaluronan degrading enzymes, including hyaluronidases, can also be used to increase delivery of chemotherapeutic agents to tumors. The hyaluronan-degrading enzyme can be administered in combination with, for example, simultaneously or prior to, one or more other chemotherapeutic or other anti-cancer agent or treatment (e.g. treatment with a taxane formulation and/or treatment with a nucleoside analog). In some cases, the enzymes can increase the sensitivity of tumors that are resistant to conventional chemotherapy. For example, hyaluronan degrading enzymes, including hyaluronidases, such as rHuPH20, can be administered to a patient in an amount effective to increase diffusion around the tumor site (e.g., to facilitate circulation and/or concentrations of chemotherapeutic agents in and around the tumor site), inhibit tumor cell motility, such as by hyaluronic acid degradation, and/or to lower the tumor cell apoptosis threshold. This can bring the tumor cell(s) to a state of anoikis, which renders the tumor cell more susceptible to the action of chemotherapeutic agents. Administration of a hyaluronan-degrading enzyme, such as a hyaluronidase, can induce responsiveness of previously chemotherapy-resistant tumors of the pancreas, stomach, colon, ovaries, and breast (Baumgartner et al. (1988) *Reg. Cancer Treat.* 1:55-58; Zanker et al. (1986) *Proc. Amer. Assoc. Cancer Res.* 27:390). The hyaluronan degrading enzyme, such as a hyaluronidase, typically enhances penetration of chemotherapeutic or other anti-cancer agents into solid tumors, thereby treating the disease.

Selection of Subjects for Treatment

The methods include steps for selecting subjects for treatment that have a hyaluronan-associated tumor or cancer. Such methods include methods for detecting hyaluronan-associated disease markers, which include any indication that a subject has a hyaluronan-associated disease, that the subject is likely to respond to treatment by an anti-hyaluronan agent, such as a hyaluronan degrading enzyme, and/or that a sample from the subject, such as a tissue, cell or fluid, contains elevated hyaluronan expression. Exemplary assays for detecting markers are described below, and include assays for measuring HA level and/or relative HA levels in a sample from a subject, assays for analyzing effects of hyaluronan-degrading enzymes on a sample from the subject, and assays for measuring readouts typically associated with certain hyaluronan-associated diseases/conditions, such as low hyaluronidase expression or activity, high interstitial fluid pressure, vascular volume and water content. In general, any known assay for detection of proteins or nucleic acids in samples from subjects, or for assessing the effects of treatment on cells/tissues in vitro can be used.

Subjects selected for treatment in the methods provided herein include subjects having elevated, aberrant or accumulated levels of hyaluronan compared to subjects not having the disease or condition or compared to normal tissues or samples that do not have elevated, aberrant or accumulated expression of HA. Any sample or tissue from a subject can be tested and compared to a normal sample or tissue. Hyaluronan levels can be measured from any source such as from a tissue (e.g. by biopsy), tumor, cells, or from blood, serum, urine or other body fluids. For example, as described elsewhere herein, profiles of HA deposition in solid tumors have generally been categorized as pericellular or stromal. Elevated plasma levels of HA have been observed most notably in patients with Wilm's tumor, mesothelioma and liver metastases. Thus, depending on the disease or condition, a different sample can be measured for hyaluronan levels. The choice of sample is within the level of one of skill in the art.

The assay used to measure hyaluronidase substrate levels is a function of the disease or condition and can be chosen based on the particular disease or condition. One of skill in the art is familiar with methods of detecting hyaluronan, which include, but are not limited to, immunohistochemistry methods or ELISA methods.

In one example, the step for detecting markers is performed prior to treating a subject, for example, to determine whether the subject has a hyaluronan-associated condition or disease that will be amenable to treatment with a hyaluronan-degrading enzyme. In this example, if the marker is detected (e.g. if it is determined that a cell, tissue or fluid from the patient contains elevated hyaluronan expression or is responsive to hyaluronan degrading enzyme), a treatment step is performed, where a hyaluronan-degrading enzyme is administered to the subject. In one example, when the marker is not detected (e.g. if it is determined that a cell, tissue or fluid from the patient contains normal or non-elevated hyaluronan expression or is not responsive to hyaluronan degrading enzyme) another treatment option may be selected.

In another example, the step for detecting markers is performed after treating a subject, or during the course of treatment of the subject, (e.g. treatment with the anti-hyaluronan agent, such as the hyaluronan-degrading enzyme (e.g. soluble modified hyaluronidase) (with or without a co-administered agent)), for example, to determine whether the treatment with the anti-hyaluronan agent is having an effect on treating the disease or condition. In one such example, the marker is not detected or is detected at an amount or relative level that is decreased compared to the amount/level prior to treatment, or compared to another sample, treatment is continued, another round of treatment is performed, or another treatment, such as a combination therapy, is initiated. In another such example, if the marker is detected at the same level as prior to treatment or another sample, another treatment option may be selected.

The assays to detect markers of hyaluronan-associated diseases and conditions include assays to measure amount (e.g. relative amount) of hyaluronan and/or hyaluronidase expression in a tissue, cell and/or body fluid of a subject, for example, a tumor. Included amongst such assays are those that can detect HA expression, Hyaluronan synthase 1 (HAS1) expression, Hyaluronan synthase 2 (HAS2) expression, Hyaluronan synthase 3 (HAS3) expression, the presence of HALOs (pericellular matrix regions that are rich in proteoglycans, including hyaluronan), and the presence of hyaluronan-degrading enzymes, such as hyaluronidases, for example, in samples from the subject.

Assays to detect protein and nucleic acid levels are well known in the art and can be used in the methods herein to measure hyaluronan, hyaluronan synthase or other protein and/or nucleic acid expression. Such assays include, but are not limited to, ELISA, SDS-PAGE, Western Blot, PCR, RT-PCR, immunohistochemistry, histology and flow cytometry. For example, a sample from a subject, such as a tissue sample (e.g. a biopsy of a tumor from a patient or animal model, a stromal sample), a fluid (e.g. blood, urine, plasma, saliva or other sample), a cell or cellular sample, or extract, or other sample, can be stained with anti-HA antibodies or HA binding proteins, for example, using histological staining, such as immunohistochemistry (IHC) of fixed or frozen tissue sections, to determine the presence and extent of hyaluronan in the tissue or sample, or immunofluorescent cellular staining, pull-down assays, and flow cytometry. In another example, the sample, e.g. biopsy, can be assayed by RT-PCR to assess the amount of HA mRNA.

Known methods for detection of hyaluronan-expression in cancer include, but are not limited to, the ELISA-like assay described in Lokeshwar et al., (1997) *Cancer Res.* 57: 773-777, for measuring HA levels in urine or bladder tissue extracts of subjects having bladder cancer. For the assay, urine or extracts are coated on microwell plates (umbilical cord HA used as a standard also is coated), followed by incubation (e.g. 16 hours, room temperature) with a labeled (e.g. biotinylated) HA binding protein, such as those described herein, washed and the HA-binding protein bound to the wells quantified using an avidin-biotin detection agent substrate. Such methods are well known in the art. In one example, the urine from a subject with an HA-associated bladder cancer contained HA levels that were elevated 2-9 fold compared to urine/extracts from normal patients (healthy subjects or subjects with other gastrourinary diseases or conditions); thus the marker would be detected if the HA levels in the urine was elevated compared to normal subjects, e.g. elevated from between at or about 2-fold and at or about 9-fold, e.g. at or about 2, 3, 4, 5, 6, 7, 8 or 9-fold elevation compared to normal subject.

In a further example, hyaluronan expression and production in tumor cells in vitro can be assessed using any one of the methods described above. Similarly, Hyaluronan synthase production (e.g. HAS 1, HAS2 or HAS3) and/or expression by cells in vitro, ex vivo or in vivo also can be assayed by, for example, ELISA, SDS-PAGE, Western Blot, PCR, RT-PCR, immunohistochemistry, histology or flow cytometry.

In another example, the amount of hyaluronidase activity in a sample from the subject is determined, such as in the blood or plasma such as with a turbidity assay.

In another example, a cell or other tissue from a patient is isolated, e.g. a tumor cell, and used in a study to determine whether the cell or tissue is responsive to treatment with the hyaluronan degrading enzyme in vitro, for example, using a clonogenic assay or any other assay for measuring growth, proliferation and/or survival of cells or tissues, such as tumor cells, in response to treatment. For example, cancer cells from a subject can be seeded on surface, such as an extracellular matrix or protein mixture, such as the mixture sold under the trade name Matrigel®(BD Biosciences). In this example, the hyaluronan-associated marker is the sensitivity of the cell or tissue to administration of hyaluronan degrading enzyme. In this example, if any property, such as proliferation, growth or survival of the cells, is inhibited or blocked by addition of hyaluronan degrading enzyme, it is determined that the subject may be amenable to treatment with hyaluronan degrading enzyme containing compositions.

In addition to assays for determining hyaluronan expression levels, other assays can be used to select a subject for treatment, and/or to assess treatment efficacy and/or duration. Interstitial fluid pressure (IFP) can be measured using an appropriate probe or instrument. For example, a transducer-tipped catheter can be used to measure the IFP in cancer tissues or other tissues of interest. The catheter is passed through the inner bore of a surgical needle, which is then inserted into the center of the tumor. The needle is withdrawn while the catheter is held in position. The IFP (mmHg) can then be measured using an appropriate data acquisition unit (Ozerdem et al. (2005) *Microvasc. Res.* 70:116-120). Other methods to measure IFP include the wick-in-needle method (Fadnes et al. (1977) *Microvasc. Res.* 14:27-36).

Vascular volume can be measured by, for example, using ultrasound imaging. This method employs hyper-echoic microbubbles to provide the strong ultrasound wave reflections that are detected. The microbubbles, when injected, such as intravenously, into a subject or animal model, move through the vascular space due to their size. Assays to assess tissue water content, such as tumor tissue water content, also are known in the art. For example, samples from a tumor can be harvested, blotted, weighed and snap frozen before being lyophilized. The water weight is then reported as the tissue wet weight to dry (i.e. lyophilized) weight ratio.

The ability of a tumor cell to form pericellular matrices (halos) in vitro can be assessed using a particle exclusion assay. Small particles (formalin-fixed red blood cells) can be added to low-density cultures of tumor cells in the presence of, for example, aggrecan, which is a large aggregating chondroitin sulfate proteoglycan. After the particles settle, the cultures can be viewed at 400× magnification to determine whether any halos were formed by the tumor cells. This can are visualized as areas around the cells from which the particles are excluded.

For any of the detection methods, the marker (e.g. HA expression, responsiveness to hyaluronan degrading enzyme, HA-synthase expression or hyaluronidase activity) typically is compared to a control sample, such that detection of the marker typically includes determining that the readout is elevated or reduced compared to the control sample.

For example, the control sample can be another tissue, cell or body fluid, such as a normal tissue, cell or body fluid, for example, a tissue, cell or body fluid that is analogous to the sample being tested, but isolated from a different subject, such as a subject that is normal (i.e. does not have a disease or condition, or does not have the type of disease or condition that the subject being tested has), for example, a subject that does not have a hyaluronan-associated disease or condition, or an analogous tissue from another subject that has a similar disease or condition, but whose disease is not as severe and/or is not hyaluronan-associated or expresses relatively less hyaluronan and thus is hyaluronan-associated to a lesser degree. For example, when the cell, tissue or fluid being tested is a subject having a cancer, it can be compared to a tissue, cell or fluid from a subject having a less severe cancer, such as an early stage, differentiated or other type of cancer. In another example, the control sample is a fluid, tissue, extract (e.g. cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines.

It is understood that the particular change, e.g. increase in or decrease in HA, is dependent on the assay used. For example, in an ELISA, the fold increase or decrease in absorbance at a particular wavelength or in quantity of protein (e.g. as determined by using a standard curve) can be expressed relative to a control. In a PCR assay, such as RT-PCR, can be compared to control expression levels (e.g. expressed as fold change) using methods known to those in the art, such as using standards.

For example, when the amount of hyaluronan in a sample from a subject is being tested, detection of the marker can be determining that the amount of HA in the sample (e.g. cancerous cell, tissue or fluid) from the subject is elevated compared to a control sample, such as a control sample described in the previous paragraph. In one example, the cancer is determined to be a hyaluronan-rich cancer if the amount of HA in the tissue, cell or fluid is elevated at or about 0.5-fold, 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 20-fold, or more, compared to the control sample, which can be, for example, but not limited to, a fluid, tissue, extract (e.g. cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines. In addition, in such methods, the level of cell-associated hyaluronan can be scored as low, moderate or high. For example, HA expression is considered high or moderate if 30%, 35%, 40%, 50%, 60%, 70%, 75%, 80%, 85%, 90% or more of the tumoral area showed persistent HA signal. Typically, treatment of subjects with at least moderate to high HA is contemplated herein.

2. Dosage and Administration

The combination therapy provided herein containing an anti-hyaluronan agent, such as a hyaluronan-degrading enzyme, and a tumor-targeted taxane, and optionally in further combination with a nucleoside analog, is administered in an amount sufficient to exert a therapeutically useful effect. Typically, the active agents are administered in an amount that does not result in undesirable side effects of the patient being treated, or that minimizes or reduces the observed side effects as compared to dosages and amounts required for single treatment with one of the above agents. For example, as described elsewhere herein, it is found herein that the combination therapy with a polymer-conjugated hyaluronan-degrading enzyme and a tumor-targeted taxane results in increased intratumoral delivery and increased intratumoral half-life of a co-administered nucleoside analog, e.g. a gemcitabine. Thus, the amount of a nucleoside analog (e.g. gemcitabine) that can be administered in the combination therapy provided herein, compared to the amounts of a nucleoside analog administered using prior art methods (e.g. gemcitabine monotherapy or dual therapy in conjunction with one other agent) is reduced, while achieving substantially the same or improved therapeutic efficacy. By virtue of the decreased dosage that is administered, side effects associated with nucleoside analog (e.g. gemcitabine) administration, such as immunosuppression or myelosuppression, are reduced, minimized or avoided.

It is within the level of one of skill in the art to determine the precise amounts of active agents, including anti-hyaluronan agent, e.g., polymer-conjugated hyaluronan-degrading enzyme, tumor-targeted taxane, and optionally a nucleoside analog, to be administered to a subject. For example, such agents and uses for treating diseases and conditions, such as cancers and solid tumors, are well known in the art. Thus, dosages of such agents in a composition or combination therapy can be chosen based on standard dosing regimes for that agent under a given route of administration.

It is understood that the precise dosage and duration of treatment is a function of the tissue or tumor being treated and may be determined empirically using known testing protocols or by extrapolation from in vivo or in vitro test data and/or can be determined from known dosing regimes of the particular agent. It is to be noted that concentrations and dosage values may also vary with the age of the individual treated, the weight of the individual, the route of administration and/or the extent or severity of the disease and other factors that are within the level of a skilled medical practioner to consider. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects). It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof.

For example, the polymer-conjugated hyaluronan-degrading enzyme, such as a hyaluronidase for example a PH20 (e.g. PEGPH20), is administered in a therapeutically effective amount to degrade or cleave tumor-associated hyaluronan. The amount of a hyaluronan degrading enzyme, such as a soluble hyaluronidase, to be administered for the treatment of a disease or condition, for example a cancer or solid tumor such as an HA-rich tumor, can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease. Exemplary dosage range is at or about 50 Units to 50,000,000 Units of a hyaluronan-degrading enzyme conjugated to a polymer, or a functionally equivalent amount of another hyaluronan degrading enzyme conjugated to a polymer. It is understood herein that a unit of activity is normalized to a standard activity, for example, an activity as measured in a microturbidity assay assaying hyaluronidase activity.

Thus, for example, a hyaluronan-degrading enzyme, such as a hyaluronidase for example a PH20, conjugated to polymer, for example, a PEG, can be administered at or about 10 to 50,000,000 Units, 10 to 40,000,000 Units, 10 to 36,000,000 Units, 10 to 12,000,000 Units, 10 to 1,200,000 Units, 10 to 1,000,000 Units, 10 to 500,000 Units, 100 to 100,000 Units, 500 to 50,000 Units, 1000 to 10,000 Units, 5000 to 7500 Units, 5000 Units to 50,000 Units, or 1,000 to 10,000 Units. Generally, a polymer-conjugated hyaluronan-degrading enzyme is administered to a subject in an amount that is between or about between 0.01 µg/kg to 25 mg/kg, such as 0.0005 mg/kg (0.5 µg/kg) to 25 mg/kg, 0.5 µg /kg to 10 mg/kg, 0.02 mg/kg to 1.5 mg/kg, 0.01 µg/kg to 15 µg/kg, 0.05 µg/kg to 10 µg/kg, 0.75 µg/kg to 7.5 µg/kg or 1.0 µg/kg to 3.0 µg/kg. The polymer-conjugated hyaluronan-degrading enzyme can be administered, for example, at a dosage of at least or about at least 0.0005 mg/kg (of the subject), 0.0006 mg/kg, 0.0007 mg/kg, 0.0008 mg/kg, 0.0009 mg/kg, 0.001 mg/kg, 0.0016 mg/kg, 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.016 mg/kg, 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg.kg, 0.6 mg/kg, 0.7 mg/kg, 0.8 mg/kg, 0.9 mg/kg,1.0 mg/kg, 1.1 mg/kg, 1.2 mg/kg, 1.3 mg/kg, 1.4mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 11 mg/kg, 12 mg/kg, 13 mg/kg, 14 mg/kg, 15 mg/kg, 16 mg/kg, 17 mg/kg, 18 mg/kg1, 19 mg/kg, 20 mg/kg, 21 mg/kg, 22 mg/kg, 23 mg/kg, 24 mg/kg, 25 mg/kg, or more is administered, to an average adult human subject, typically weighing about 70 kg to 75 kg.

A polymer-conjugated hyaluronan-degrading enzyme, such as a PEGylated hyaluronidase (e.g. PEGPH20), provided herein can be administered at between or about between 1 Unit/kg to 800,000 Units/kg, such as 10 to 800,000 Units/kg, 10 to 750,000 Units/kg, 10 to 700,000 Units/kg, 10 to 650,000 Units/kg, 10 to 600,000 Units/kg, 10 to 550,000 Units/kg, 10 to 500,000 Units/kg, 10 to 450,000 Units/kg, 10 to 400,000 Units/kg, 10 to 350,000 Units/kg, 10 to 320,000 Units/kg, 10 to 300,000 Units/kg, 10 to 280,000 Units/kg, 10 to 260,000 Units/kg, 10 to 240,000 Units/kg, 10 to 220,000 Units/kg, 10 to 200,000 Units/kg, 10 to 180,000 Units/kg, 10 to 160,000 Units/kg, 10 to 140,000 Units/kg, 10 to 120,000 Units/kg, 10 to 100,000 Units/kg, 10 to 80,000 Units/kg, 10 to 70,000 Units/kg, 10 to 60,000 Units/kg, 10 to 50,000 Units/kg, 10 to 40,000 Units/kg, 10 to 30,000 Units/kg, 10 to 20,000 Units/kg, 10 to 15,000 Units/kg, 10 to 12,800 Units/kg, 10 to 10,000 Units/kg, 10 to 9,000 Units/kg, 10 to 8,000 Units/kg, 10 to 7,000 Units/kg, 10 to 6,000 Units/kg, 10 to 5,000 Units/kg, 10 to 4,000 Units/kg, 10 to 3,000 Units/kg, 10 to 2,000 Units/kg, 10 to 1,000 Units/kg, 10 to 900 Units/kg, 10 to 800 Units/kg, 10 to 700 Units/kg, 10 to 500 Units/kg, 10 to 400 Units/kg, 10 to 300 Units/kg, 10 to 200 Units/kg, 10 to 100 Units/kg, 16 to 600,000 Units/kg, 16 to 500,000 Units/kg, 16 to 400,000 Units/kg, 16 to 350,000 Units/kg, 16 to 320,000 Units/kg, 16 to 160,000 Units/kg, 16 to 80,000 Units/kg, 16 to 40,000 Units/kg, 16 to 20,000 Units/kg, 16 to 16,000 Units/kg, 16 to 12,800 Units/kg, 16 to 10,000 Units/kg, 16 to 5,000 Units/kg, 16 to 4,000 Units/kg, 16 to 3,000 Units/kg, 16 to 2,000 Units/kg, 16 to 1,000 Units/kg, 16 to 900 Units/kg, 16 to 800 Units/kg, 16 to 700 Units/kg, 16 to 500 Units/kg, 16 to 400 Units/kg, 16 to 300 Units/kg, 16 to 200 Units/kg, 16 to 100 Units/kg, 160 to 12,800 Units/kg, 160 to 8,000 Units/kg, 160 to 6,000 Units/kg, 160 to 4,000 Units/kg, 160 to 2,000 Units/kg, 160 to 1,000 Units/kg, 160 to 500 Units/kg, 500 to 5000 Units/kg, 1000 to 100,000 Units/kg or 1000 to 10,000 Units/kg, of the mass of the subject to whom it is administered. In some examples, a hyaluronan-degrading enzyme, such as a polymer-conjugated hyaluronan-degrading enzyme, such as a PEGylated hyaluronidase (e.g. PEGPH20) can be administered at or about 1 Unit/kg to 1000 Units/kg, 1 Units/kg to 500 Units/kg or 10 Units/kg to 50 Units/kg.

Generally, where the specific activity of the PEGylated hyaluronidase is or is about 10,000 U/mg to 80,000 U/mg, such as 20,000 U/mg to 60,000 U/mg or 18,000 U/mg to 45,000 U/mg, generally at or about 1 Units/kg (U/kg), 2 U/kg, 3 U/kg, 4 U/kg, 5 U/kg, 6 U/kg, 7 U/kg, 8 U/kg, 8 U/kg 10 U/kg, 16 U/kg, 32 U/kg, 64 U/kg, 100 U/kg, 200 U/kg, 300 U/kg, 400 U/kg, 500 U/kg, 600 U/kg, 700 U/kg, 800 U/kg, 900 U/kg, 1,000 U/kg, 2,000 U/kg, 3,000 U/kg, 4,000 U/kg, 5,000 U/kg, 6,000 U/kg, 7,000 U/kg, 8,000 U/kg, 9,000 U/kg, 10,000 U/kg, 12,800 U/kg, 20,000 U/kg, 32,000 U/kg, 40,000 U/kg, 50,000 U/kg, 60,000 U/kg, 70,000 U/kg, 80,000 U/kg, 90,000 U/kg, 100,000 U/kg, 120,000 U/kg, 140,000 U/kg, 160,000 U/kg, 180,000 U/kg, 200,000 U/kg, 220,000 U/kg, 240,000 U/kg, 260,000 U/kg, 280,000 U/kg, 300,000 U/kg, 320,000 U/kg, 350,000 U/kg, 400,000 U/kg, 450,000 U/kg, 500,000 U/kg, 550,000 U/kg, 600,000 U/kg, 650,000 U/kg, 700,000 U/kg, 750,000 U/kg, 800,000 U/kg or more, per mass of the subject, is administered. For example, 60,000 U; 70,000 U; 80,000 U; 90,000 U; 100,000 U; 200,000 U; 300,000 U; 400,000 U; 500,000 U; 600,000 U; 700,000 U; 800,000 U; 900,000 U; 1,000,000 U; 1,500,000 U; 2,000,000 U; 2,500,000 U; 3,000,000 U; 3,500,000 U; 4,000,000 U or more is administered.

In examples herein, tumor-targeted taxane, such as an albumin-bound taxane (e.g. albumin-bound paclitaxel), is administered in a therapeutically effective amount sufficient to achieve intratumoral delivery. In some examples, a tumor-targeted taxane, such as an albumin-bound taxane (e.g. albumin-bound paclitaxel) is administered in a therapeutically effective amount to reduce intratumoral deaminase (e.g. cytidine deaminase) protein levels compared to the absence of treatment, such as to reduce or decrease the levels by at least or about at least 10%, 20%, 30%, 40%, 50%, 60%, 70%, 80%, 90% or more. In particular examples, a tumor-targeted taxane, such as an albumin-bound taxane (e.g. albumin-bound paclitaxel) is administered in a therapeutically effective amount to increase the intratumoral level of a co-administered nucleoside analog (e.g. gemcitabine or derivate) compared to the absence of treatment. For example, intratumoral gemcitabine is increased by at least or about at least 10%, 20%, 30%, 40%, 50%, 60%, 70%, 80%, 90% or more. The amount of a tumor-targeted taxane, such as an albumin-bound taxane (e.g. albumin-bound paclitaxel) to be administered for the treatment of a disease or condition, for example a cancer or solid tumor such as an HA-rich tumor, can be determined by standard clinical techniques. In addition, in vitro assays and animal models can be employed to help identify optimal dosage ranges. The precise dosage, which can be determined empirically, can depend on the particular taxane, the particular formulation (e.g. nanoparticle or lipsome formulation), the route of administration, the type of disease to be treated and the seriousness of the disease.

Typically, a tumor-targeted taxane, such as an albumin-bound taxane (e.g. albumin-bound paclitaxel) is administered to a subject relative to the body surface area (BSA; $m^2$) of the subject of between or about between 1 $mg/m^2$ to 1000 $mg/m^2$, s such as between or about between 10 $mg/m^2$ to 500 $mg/m^2$, 50 $mg/m^2$ to 400 $mg/m^2$, 25 $mg/m^2$ to 300 m $g/m^2$, and generally at least or about or at least or about or 20 $mg/m^2$, 30 $mg/m^2$, 40 $mg/m^2$, 50 $mg/m^2$, 60 $mg/m^2$, 70 $mg/m^2$, 80 $mg/m^2$, 90 $mg/m^2$, 100 $mg/m^2$, 150 $mg/m^2$, 200 $mg/m^2$, 250 $mg/m^2$, 300 $mg/m^2$. In some cases, lower dosages of a tumor-targeted taxane, such as an albumin-bound taxane (e.g. albumin-bound paclitaxel), can be administered to subjects compared to existing formulations or dosage regimes. For example, a tumor-targeted taxane, such as an albumin-bound taxane (e.g. albumin-bound paclitaxel), is administered to a subject in an amount that is at least or about at least 50 mg/m$^2$ or 100 mg/m2, but that is less than 260 mg/m$^2$, 200 mg/m2 or 150 mg/m$^2$. In other examples, the dosage that is administered per administration is the same as existing dosages and dosage regimines, but the dosage schedule is reduced so that a lower amount of nucleoside analog is administered per cycle of administration. In other cases, higher dosages of a tumor-targeted taxane, such as an albumin-bound taxane (e.g. albumin-bound paclitaxel), can be administered to subjects compared to existing formulations or dosage regimes. For example, a tumor-targeted taxane, such as an albumin-bound taxane (e.g. albumin-bound paclitaxel), is administered to a subject in an amount that is at least or about at least 300 mg/m$^2$, such as between or about between 300 mg/m$^2$ to 1000 mg/m$^2$. It is within the level of one of skill in the art to convert or determine corresponding dosages in mg/kg based on the height and weight of a subject. For example, the BSA is determined by the formula (height (cm)×weight (kg)/3600)$^{1/2}$. The BSA of an average adult is 1.73 m$^2$.

In examples herein, the combination therapy optionally contains further administration of a nucleoside analog (e.g. a gemcitabine or derivative or other analog). The gemictabine is administered in a therapeutically effective amount sufficient to achieve intratumoral delivery. In particular examples, the nucleoside analog (e.g. a gemciatbine or derivative or other analog) is co-administered in the combination therapy herein in an amount to achieve an intratumoral level that is at least 1.5-fold, 2-fold, 3-fold, 4-fold, 5-fold 10-fold or more increased compared to the intratumoral level when administered alone. The amount of a nucleoside analog (e.g. gemcitabine, derivative thereof or other analog described herein) to be administered for the treatment of a disease or condition, for example a cancer or solid tumor such as an HA-rich tumor, can be determined by standard clinical techniques. In addition, in vitro assays and animal models can be employed to help identify optimal dosage ranges. The precise dosage, which can be determined empirically, can depend on the particular nucleoside analog, the particular formulation, the route of administration, the type of disease to be treated and the seriousness of the disease.

Typically, a nucleoside analog (e.g. gemcitabine or derivative thereof or other analog) is administered to a subject relative to the body surface area (BSA; m$^2$) of the subject of between or about between 100 mg/m$^2$ to 2500 mg/m$^2$, such as between or about between 500 mg/m$^2$ to 2000 mg/m$^2$, 750 mg/m$^2$ to 1500 mg/m$^2$, 1000 mg/m$^2$ to 1500 mg/m$^2$, or 500 mg/m$^2$ to 1500 mg/m$^2$, and generally at least or about at least or about or 500 mg/m$^2$, 600 mg/m$^2$, 700 mg/m$^2$, 800 mg/m$^2$, 900 mg/m$^2$, 1000 mg/m$^2$, 1250 mg/m$^2$, 1500 mg/m$^2$, 1750 mg/m$^2$, 2000 mg/m$^2$ or more. In some cases, lower dosages of a nucleoside analog (e.g. gemcitabine or derivative thereof or other taxane), can be administered to subjects compared to existing formulations or dosage regimes. For example, a nucleoside analog (e.g. gemcitabine or derivative thereof or other taxane), is administered to a subject in an amount that is at least or about at least 200 mg/m$^2$ or 500 mg/m2, but that is less than 1000 mg/m$^2$ or 1250 mg/m2. In other cases, the dosage that is administered per administration is the same as existing dosages and dosage regimines, but the dosage schedule is reduced so that a lower amount of nucleoside analog is administered per cycle of administration. It is within the level of one of skill in the art to determine the corresponding dosage in mg/kg.

The agents provided herein can be administered intravenously, subcutaneously, intratumorally, intradermally, orally or by other routes of administration. The particular route can differ between the administered agents or can be the same. For example, one or more, or all agents, can be administered subcutaneously. In particular examples, it is contemplated herein that a polymer-conjugated hyaluronan-degrading enzyme can be administered subcutaneously. In such examples, the polymer-conjugated hyaluronan-degrading enzyme is administered in a dosage regimen that permits 1-8 hours, such as 1-2 hours, of absorption to achieve bioavailable enzyme in the bloodstream in order to result in similar tumor activity as a simultaneous intravenous dosage regimen. In examples herein, the tumor-targeted taxane and/or nucleoside analog also can be administered subcutaneously. The particular subcutaneous formulation or co-formulation of the one or more agents is provided so as to achieve sufficient bioavailability of the agent and to minimize injection site reactions.

In another example, one or more, or all agents, can be administered intravenously. In such an example, one or more, or all, of the agents can be administered by push or by infusion. The push or infusion time can be 1 minute to 60 minutes, and generally about 10 minutes to 40 minutes and no more than 60 minutes. The agents can be administered by concurrent infusion or by subsequent infusion. In one example, two of the agents or all three of the administered agents in the combination therapy provided herein are simultaneously infused. In such an example, the administered agents are provided in the same composition for infusion together in the same bag. In other cases, the administered agents are provided in separate compositions, but are combined into a single bag as one infusate just prior to infusion. In a further example, the administered agents are simultaneously or near simultaneously infused or subsequently infused, and hang in separate bags for separate infusions.

3. Dosage Regimen: Frequency and Cycle of Administration

The anti-hyaluronan agent, such as the polymer-conjugated hyaluronan-degrading enzyme, can be administered prior to, simultaneously or near simultaneously, sequentially or intermittently with the tumor-targeted taxane. For example, the anti-hyaluronan agent, e.g., polymer-conjugated hyaluronan-degrading enzyme, and tumor-targeted taxane can be co-administered together or separately. If administered separately, the agents can be administered immediately apart from each other, such as administered within 30 seconds to 15 minutes of each other, such as less than 15 minutes, 14 minutes, 12 minutes, 10 minutes, 5 minutes, 2 minutes, 1 minute or 30 seconds apart from each other. In other cases, the anti-hyaluronan agent, such as the polymer-conjugated hyaluronan-degrading enzyme, and tumor-targeted taxane are administered sequentially and/or intermittently. In such examples, the anti-hyaluronan agent, e.g., the hyaluronan-degrading enzyme, can be administered first or the tumor-targeted taxane can be administered first. Generally, the anti-hyaluronan agent, such as a hyaluronan-degrading enzyme, is administered prior to the tumor-targeted taxane. For example, the anti-hyaluronan agent, or hyaluronan-degrading enzyme, is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours prior to administration of the tumor-targeted taxane.

In examples of the combination therapy herein, the nucleoside analog can be administered prior to, simultaneously or near simultaneously, sequentially or intermittently with the anti-hyaluronan agent (e.g. hyaluronan-degrading enzyme) and/or tumor-targeted taxane. The nucleoside analog can be co-administered together or separately with one or both of the anti-hyaluronan agent (e.g. hyaluronan-degrading enzyme) and/or tumor-targeted taxane. If administered separately, the nucleoside analog can be administered immediately before or after administration of the anti-hyaluronan agent, such as the hyaluronan-degrading enzyme, and/or tumor-targeted taxane, such as administered within 30 seconds to 15 minutes of each other, such as less than 15 minutes, 14 minutes, 12 minutes, 10 minutes, 5 minutes, 2 minutes, 1 minute or 30 seconds apart from the anti-hyaluronan agent (e.g. hyaluronan-degrading enzyme) and/or tumor-targeted taxane. Generally, the nucleoside analog is administered after the anti-hyaluronan agent, such as the hyaluronan-degrading enzyme. In some cases, the nucleoside analog is administered after the anti-hyaluronan agent, such as the hyaluronan-degrading enzyme, and tumor-targeted taxane. For example, the nucleoside analog is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours after administration of the anti-hyaluronan agent (e.g. hyaluronan-degrading enzyme) and/or tumor-targeted taxane.

In one example herein, the anti-hyaluronan agent, such as the hyaluronan-degrading enzyme, is administered separately from the other agents and is administered immediately before or after the tumor-targeted taxane. For example, the hyaluronan-degrading enzyme is administered less than 15 minutes, 14 minutes, 12 minutes, 10 minutes, 5 minutes, 2 minutes, 1 minute or 30 seconds before or after the tumor-targeted taxane. In such examples, the nucleoside analog is administered after the anti-hyaluronan agent (e.g. hyaluronan-degrading enzyme) and tumor-targeted taxane. For example, the nucleoside analog is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours after administration of the hyaluronan-degrading enzyme and tumor-targeted taxane.

In another example, the anti-hyaluronan agent, such as the hyaluronan-degrading enzyme, is administered before the tumor-targeted taxane, which is administered before the nucleoside analog. For example, the anti-hyaluronan agent (e.g., hyaluronan-degrading enzyme) is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours before administration of the tumor-targeted taxane. In such an example, the nucleoside analog is administered at least or at least about or about or 5 minutes, 15 minutes, 30 minutes, 1 hour, 2 hours, 3 hours, 4 hours, 6 hours, 8 hours, 12 hours, 16 hours, 18 hours, 20 hours, 22 hours, 24 hours, 30 hours, 36 hours, 40 hours or 48 hours after administration of the tumor-targeted taxane.

The frequency and timing of administration, and the dosage amounts, can be administered periodically over a cycle of administration to maintain a continuous and/or long term effect of the active agents for a desired length of time. The combinations or compositions can be administered hourly, daily, weekly, monthly, yearly or once. The length of time of the cycle of administration can be empirically determined, and is dependent on the disease to be treated, the severity of the disease, the particular patient, and other considerations within the level of skill of the treating physician. The length of time of treatment with a combination therapy provided herein can be one week, two weeks, one months, several months, one year, several years or more. The dosages can be divided into a plurality of cycles of administration during the course of treatment. For example, a modified hyaluronidase enzyme can be administered twice weekly over a period of a year or more. If disease symptoms persist in the absence of discontinued treatment, treatment can be continued for an additional length of time. Over the course of treatment, evidence of disease and/or treatment-related toxicity or side effects can be monitored.

In addition, the cycle of administration can be tailored to add periods of discontinued treatment in order to provide a rest period from exposure to the agents. The length of time for the discontinuation of treatment can be for a predetermined time or can be empirically determined depending on how the patient is responding or depending on observed side effects. For example, the treatment can be discontinued for one week, two weeks, one month or several months. Generally, the period of discontinued treatment is built into a cycle of dosing regime for a patient.

For example, an exemplary dosing regime is a treatment cycle or cycle of administration of 28 days. The agent, such as the anti-hyaluronan agent, e.g., polymer-conjugated hyaluronan-degrading enzyme, tumor-targeted taxane and/or nucleoside analog, can be administered once weekly or twice weekly. For example, the agent can be administered for the first 3 weeks, once weekly or twice weekly, followed by a one week without dosing. Thus, for example, a patient can be dosed with the agent twice weekly on days 1, 4, 8, 11, 15 and 18 (or days 0, 3, 6, 9, 12 and 15), followed by a one-week of discontinued treatment, over the course of the 28-day cycle. In another example, a patient can be dosed with the agent once weekly on days 1, 8 and 16, followed by a one-week of discontinued treatment over the course of the 28-day cycle. In another example, the agent can be administered for the full 28 days once weekly or twice weekly. Thus, for example, a patient can be dosed with the agent twice weekly on days 1, 4, 8, 11, 15, 18, 21 and 24 (or days 0, 4, 7, 11, 14, 18, 21 or 25) for the full 28 day cycle. In other examples, a patient can be dosed with the agent once weekly on days 1, 8, 16 or 24 for the full 28 day cycle. It is understood that the above description is for exemplification purposes only and that variations of the above can be employed. Further, similar cycles of administration can be applied to all administered agents, or each administered agent can be employed in its own dosing regimine in the combination therapy provided herein.

It is within the level of one of skill in the art to determine the precise cycle of administration and dosing schedule. As noted above, the cycle of administration can be for any desired length of time. Hence, the 28-day cycle of administration can be repeated for any length of time. It is within the level of skill of the treating physician to adopt a cycle of administration and dosing regime that meets the needs of the patient depending on personal considerations specific to the patient and disease to be treated.

Generally, the timing of administration of the nucleoside analog, for example gemcitabine or derivative, is typically a function of the cycle of administration of the anti-hyaluronan agent, e.g., polymer conjugated-hyaluronan-degrading enzyme, and/or tumor-targeted taxane. For example, the nucleoside analog can be adminstered after the first administration of the anti-hyaluronan agent, such as the hyaluronan-degrading enzyme, and/or tumor-targeted taxane in a cycle of administration, and/or after any one or more subsequent administrations in the cycle. In other examples, the nucleoside analog is administered after each subsequent administration of the anti-hyaluronan agent (e.g. hyaluronan-degrading enzyme) and/or tumor-targeted taxane in the cycle, after every other subsequent administration of the hyaluronan-degrading enzyme and/or tumor-targeted taxane in the cycle, or is administered once a week, once every two weeks, once every three weeks, or once a month during the cycle of administration of the anti-hyaluronan agent, e.g. hyaluronan-degrading enzyme, and/or tumor-targeted taxane. In some examples, the nucleoside analog is only administered once per cycle of administration of the anti-hyaluronan agent, e.g. hyaluronan-degrading enzyme, and/or tumor-targeted taxane. In additional example, the nucleoside analog is administered intermittently between cycles of administration. For example, the nucleoside analog is not administered during the first cycle of administration, but is administered during a second cycle, followed by skipping the third cycle and administered again during a fourth cycle, etc. . . . or any variation thereof.

In particular examples of the combination therapy herein, the methods include administering an anti-hyaluronan agent and a tumor-targeted taxane simultaneously or near simultaneously, for example concomitantly. The anti-hyaluronan agent and tumor-targeted taxane can be administered at a frequency of administration of twice weekly or once weekly for a predetermined number of weeks. In particular, the anti-hyaluronan agent is administered twice weekly and the tumor-targeted taxane is administered once weekly. Optionally, a nucleoside analog also can be administered in the combination therapy. For example, the nucleoside analog is administered once weekly for a predetermined number of weeks, and typically the nucleoside analog is administered one week after administration of the anti-hyaluronan agent and the tumor-targeted taxane. The method also can include administration of a corticosteroid prior to, concurrent with, intermittently with or subsequent to administration of the anti-hyaluronan agent. The cycle of administration can be for any time period, and is within the level of the treating physician or clinician. Typically, the predetermined number of weeks is 3 weeks or 4 weeks, but can be longer. The cycle of administration can be repeated a plurality of times depending on the disease status and response of the subject.

4. Additional Combination Treatments

The combination therapy provided herein can be used alone or in further combination with other therapies or treatments. The combinations or compositions provided herein can be further co-formulated or co-administered together with, prior to, intermittently with, or subsequent to, other therapeutic or pharmacologic agents or treatments, such as procedures. For example, such agents include, but are not limited to, other biologics, anti-cancer agents, small molecule compounds, dispersing agents, anesthetics, vasoconstrictors and surgery, and combinations thereof. Such agents also can include one or more agents to ameliorate, reduce or prevent side effects. In some cases, the combination therapy can be used in combination with one or more cancer treatments that remove the primary tumor or that immunosuppress the subject prior to treatment. For example, additional chemotherapy or radiation therapy can be used in addition to the combination therapy provided herein. Such additional therapy can have the effect of weakening a subjects immune system. In other examples, surgical removal and/or immune-system weakening therapy may not be necessary. Exemplary other methods that can be combined therein include administering a compound that decreases the rate of proliferation of the tumor or neoplastic cells without weakening the immune system (e.g., by administering tumor suppressor compounds or by administering tumor cell-specific compounds) or administering an angiogenesis-inhibiting compound.

A preparation of a second agent or agents or treatment or treatments can be administered at once, or can be divided into a number of smaller doses to be administered at intervals of time. Selected agent/treatment preparations can be administered in one or more doses over the course of a treatment time for example over several hours, days, weeks, or months. In some cases, continuous administration is useful. It is understood that the precise dosage and course of administration depends on the indication and patient's tolerability. Generally, dosing regimes for second agents/treatments herein are known to one of skill in the art.

a. Corticosteroids

The combination therapy provided herein can be used alone or in further combination with one or more corticosteroids. A corticosteroid is administered is an amount that is therapeutically effective to ameliorate or reduce one or more adverse effects of administration of a polymer-conjugated hyaluronan degrading enzymes or other agent, in particular, adverse musculoskeletal effects. A therapeutically effective amount is the dosage sufficient to ameliorate, prevent, eliminate or reduce one or more symptoms or adverse effects. Indicators of improvement or successful pretreatment include determination of the failure to manifest a relevant score on the CTCAE scale or a change in grading or severity on the CTCAE scale.

Corticosteroids are a class of steroid hormones that are produced in the adrenal cortex. Corticosteroids are involved in a wide range of physiologic systems such as stress response, immune response and regulation of inflammation, carbohydrate metabolism, protein catabolism, blood electrolyte levels, and behavior. These include glucocorticoids, which are anti-inflammatory agents with a large number of other functions and mineralocorticoids, which control salt and water balance primarily through action on the kidneys.

Glucocorticoids are a class of steroid hormones, e.g., corticosteroids, that bind to the glucocorticoid receptor. Glucocorticoids cause their effects by binding to the glucocorticoid receptor. Among other activities, the activated glucocorticoid complex in turn up-regulates the expression of anti-inflammatory proteins in the nucleus and represses the expression of pro-inflammatory proteins in the cytosol by preventing the translocation of other transcription factors from the cytosol into the nucleus.

Generally, any corticosteroid, e.g., glucocorticoid, can be used in the methods or combinations provided herein. The glucocorticoids include synthetic and non-synthetic glucocorticoids. Exemplary glucocorticoids include, but are not limited to: alclometasones, algestones, beclomethasones (e.g. beclomethasone dipropionate), betamethasones (e.g. betamethasone 17-valerate, betamethasone sodium acetate, betamethasone sodium phosphate, betamethasone valerate), budesonides, clobetasols (e.g. clobetasol propionate), clobetasones, clocortolones (e.g. clocortolone pivalate), cloprednols, corticosterones, cortisones and hydrocortisones (e.g. hydrocortisone acetate), cortivazols, deflazacorts, desonides, desoximetasones, dexamethasones (e.g. dexamethasone 21-phosphate, dexamethasone acetate, dexamethasone sodium phosphate), diflorasones (e.g. diflorasone diacetate), diflucortolones, difluprednates, enoxolones, fluazacorts, flucloronides, fludrocortisones (e.g., fludrocortisone acetate), flumethasones (e.g. flumethasone pivalate), flunisolides, fluocinolones (e.g. fluocinolone acetonide), fluocinonides, fluocortins, fluocortolones, fluorometholones (e.g. fluorometholone acetate), fluperolones (e.g., fluperolone acetate), fluprednidenes, fluprednisolones, flurandrenolides, fluticasones (e.g. fluticasone propionate), formocortals, halcinonides, halobetasols, halometasones, halopredones, hydrocortamates, hydrocortisones (e.g. hydrocortisone 21-butyrate, hydrocortisone aceponate, hydrocortisone acetate, hydrocortisone buteprate, hydrocortisone butyrate, hydrocortisone cypionate, hydrocortisone hemisuccinate, hydrocortisone probutate, hydrocortisone sodium phosphate, hydrocortisone sodium succinate, hydrocortisone valerate), loteprednol etabonate, mazipredones, medrysones, meprednisones, methylprednisolones (methylprednisolone aceponate, methylprednisolone acetate, methylprednisolone hemisuccinate, methylprednisolone sodium succinate), mometasones (e.g., mometasone furoate), paramethasones (e.g., paramethasone acetate), prednicarbates, prednisolones (e.g. prednisolone 25-diethylaminoacetate, prednisolone sodium phosphate, prednisolone 21-hemisuccinate, prednisolone acetate; prednisolone farnesylate, prednisolone hemisuccinate, prednisolone-21 (beta-D-glucuronide), prednisolone metasulphobenzoate, prednisolone steaglate, prednisolone tebutate, prednisolone tetrahydrophthalate), prednisones, prednivals, prednylidenes, rimexolones, tixocortols, triamcinolones (e.g. triamcinolone acetonide, triamcinolone benetonide, triamcinolone hexacetonide, triamcinolone acetonide 21-palmitate, triamcinolone diacetate). These glucocorticoids and the salts thereof are discussed in detail, for example, in Remington's Pharmaceutical Sciences, A. Osol, ed., Mack Pub. Co., Easton, Pa. (16th ed. 1980).

In some examples, the glucocorticoid is selected from among cortisones, dexamethasones, hydrocortisones, methylprednisolones, prednisolones and prednisones. In a particular example, the glucocorticoid is dexamethasone.

The corticosteroid is provided in a therapeutically effective dose. Therapeutically effective concentration can be determined empirically by testing in known in vitro or in vivo (e.g. animal model) systems. For example, the amount of a selected corticosteroid to be administered to ameliorate the adverse effects can be determined by standard clinical techniques. In addition, animal models can be employed to help identify optimal dosage ranges. The precise dosage, which can be determined empirically, can depend on the particular therapeutic preparation, the regime and dosing schedule, the route of administration and the seriousness of the disease.

The concentration of a selected therapeutic agent in the composition depends on absorption, inactivation and excretion rates, the physicochemical characteristics, the dosage schedule, and amount administered as well as other factors known to those of skill in the art. For example, it is understood that the precise dosage and duration of treatment is a function of the disease or condition, the tissue being treated, the patient or subject and the anti-hyaluronan agent, including amount and dosage regime. The dose of the corticosteroid also can vary depending on the age and health of the patient, the polymer-conjugated hyaluronan-degrading enzyme dosing (e.g. PEGylated hyaluronan degrading enzyme dosing), potency of the corticosteroid, and the route of administration. For example, it is to be noted that concentrations and dosage values will vary with the therapeutic dose and dosage regime of the hyaluronan degrading enzyme. Additionally, the corticosteroid can be administered daily, weekly, or monthly or over longer periods of time in order to achieve the desired results. The particular dosage volume can vary and is dependent on the dosage regime, frequency of administration and the desired rate of administration. It is to be noted that concentrations and dosage values can also vary with the age of the individual treated.

The precise dosage and duration of treatment can be determined empirically using known testing protocols or by extrapolation from in vivo or in vitro test data. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. Generally, dosage regimens are chosen to limit toxicity, and herein are chosen to ameliorate adverse side effects. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects). Administration of a therapeutic agent should not exceed the maximum dosage levels established by the United States Food and Drug Administration or published in the Physician's Desk References.

Generally, the dose of corticosteroid administered is dependent upon the specific corticosteroid, as a difference in potency exists between different corticosteroids (see Table 4 below). The corticosteroid, or glucocorticoid, for example dexamethasone, can be given orally (tablets, liquid or liquid concentrate) PO, intravenously (IV) or intramuscularly. The corticosteroid is typically administered as a bolus, but many be administered over a period of time, as long as the dose is effective to ameliorate one or more side effects associated with administration of the anti-hyaluronan agent, for example, a PEGylated hyaluronidase.

TABLE 4

Glucocorticoid administration

| Glucocorticoid (route) | Equivalent Potency (mg) |
| --- | --- |
| Hydrocortisone (IV or PO) | 20 |
| Prednisone | 5 |
| Prednisolone (IV or PO) | 5 |
| Methylprednisolone sodium succinate (IV) | 4 |
| Dexamethasone (IV or PO) | 0.5-0.75 |

The corticosteroid can be administered in any amount that is effective to ameliorate one or more side effects associated with administration of the hyaluronan degrading enzyme. Thus, the corticosteroid, e.g., glucocorticoid, can be administered, for example, at an amount between at or about 0.1 and 100 mgs, per dose, 0.1 to 80 mgs, 0.1 to 60 mgs, 0.1 to 40 mgs, 0.1 to 30 mgs, 0.1 to 20 mgs, 0.1 to 15 mgs, 0.1 to 10 mgs, 0.1 to 5 mgs, 0.2 to 40 mgs, 0.2 to 30 mgs, 0.2 to 20 mgs, 0.2 to 15 mgs, 0.2 to 10 mgs, 0.2 to 5 mgs, 0.4 to 40 mgs, 0.4 to 30 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs, to a 70 kg adult human subject. Typically, the corticosteroid, such as a glucocorticoid is administered at an amount between at or about 0.4 and 20 mgs, for example, at or about 0.4 mgs, 0.5 mgs, 0.6 mgs, 0.7 mgs, 0.75 mgs, 0.8 mgs, 0.9 mgs, 1 mg, 2 mgs, 3 mgs, 4 mgs, 5 mgs, 6 mgs, 7 mgs, 8 mgs, 9 mgs, 10 mgs, 11 mgs, 12 mgs, 13 mgs, 14 mgs, 15 mgs, 16 mgs, 17 mgs, 18 mgs, 19 mgs or 20 mgs per dose, to an average adult human subject.

The corticosteroid can be administered, for example, at a dosage of at or about 0.001 mg/kg (of the subject), 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.015 mg/kg, 0.02 mg/kg, 0.025 mg/kg, 0.03 mg/kg, 0.035 mg/kg, 0.04 mg/kg, 0.045 mg/kg, 0.05 mg/kg, 0.055 mg/kg, 0.06 mg/kg, 0.065 mg/kg, 0.07 mg/kg, 0.075 mg/kg, 0.08 mg/kg, 0.085 mg/kg, 0.09 mg/kg, 0.095 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.50 mg/kg, 0.55 mg/kg, 0.60 mg/kg, 0.65 mg/kg, 0.70 mg/kg, 0.75 mg/kg, 0.80 mg/kg, 0.85 mg/kg, 0.90 mg/kg, 0.95 mg/kg, 1 mg/kg, 1.05 mg/kg, 1.1 mg/kg, 1.15 mg/kg, 1.20 mg/kg, 1.25 mg/kg, 1.3 mg/kg, 1.35 mg/kg or 1.4 mg/kg, to an average adult human subject, typically weighing about 70 kg to 75 kg.

The dosage administered administration can vary as long as administration of the corticosteroid ameliorates one or more adverse side effects associated with administration of the hyaluronan-degrading enzyme. In one example, the dosage of glucocorticoid, for example, dexamethasone, is adminstered in successively lower dosages per treatment cycle. Hence, in such treatment regimes, the dose of corticosteroid is tapered. For example, dexamethasone is administered prior to administration of an hyaluronan-degrading enzyme, at an initial dose of 4 mg, and upon each successive administration of the hyaluronan-degrading enzyme, the dexamethasone dose is lowered, such that the dose is 3 mg for the next administration of the hyaluronan-degrading enzyme, e.g. PEGylated hyaluronidase, then 2 mg per administration of anti-hyaluronan agent, e.g. PEGylated hyaluronidase, and then 1 mg per administration of anti-hyaluronan agent, e.g. PEGylated hyaluronidase. Any dose is contemplated as long as the dose of the corticosteroid is effective to reduce one or more side effects associated with administration of the hyaluronan-degrading enzyme, e.g. a PEGylated hyaluronidase.

Time of administration can vary as long as administration of the corticosteroid ameliorates one or more adverse side effects associated with administration of the hyaluronan-degrading enzyme, such as a PEGylated hyaluronidase. The corticosteroid can be administered sequentially, intermittently, at the same time or in the same composition as hyaluronan-degrading enzyme, e.g. PEGylated hyaluronan degrading enzyme. For example, the corticosteroid can be administered before, during, simultaneously with, or after administration of the hyaluronan-degrading enzyme, e.g. PEGylated hyaluronidase. In another example, the corticosteroid and hyaluronan-degrading enzyme, e.g. PEGylated hyaluronidase are administered intermittently. Generally, the corticosteroid is administered prior to administration of the hyaluronan-degrading enzyme, e.g. PEGylated hyaluronidase. For example, the corticosteroid, e.g., glucocorticoid, such as dexamethasone, can be administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more prior to administration of the anti-hyaluronan agent, for example a PEGylated hyaluronan degrading enzyme.

In some examples, the corticosteroid is administered at the same time as administration of the hyaluronan-degrading enzyme, for example a PEGylated hyaluronan degrading enzyme. In this example, the corticosteroid can be administered together with, or separately from, the hyaluronan-degrading enzyme, e.g. a PEGylated hyaluronidase. Typically, the corticosteroid is administered separately from the hyaluronan-degrading enzyme, for example a PEGylated hyaluronan degrading enzyme. In other examples, the corticosteroid is administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more after administration of the hyaluronan-degrading enzyme, for example a PEGylated hyaluronan degrading enzyme.

In one example, the corticosteroid is administered prior to administration of hyaluronan-degrading enzyme, for example a PEGylated hyaluronidase. For example, the corticosteroid, e.g., glucocorticoid, for example, dexamethasone, is administered 1 hour prior to the administration of the hyaluronan-degrading enzyme, e.g. a PEGylated hyaluronidase. In another example, the corticosteroid is administered 5 minutes before the administration of the hyaluronan-degrading enzyme, e.g. a PEGylated hyaluronan degrading enzyme. In another example, the corticosteroid is administered both prior to and after the administration of hyaluronan-degrading enzyme, e.g. a PEGylated hyaluronidase. In this example, the corticosteroid, such as dexamethasone, is administered one to five minutes immediately before administration of the hyaluronan-degrading enzyme, e.g. a PEGylated hyaluronan degrading enzyme and eight hours after administration of the anti-hyaluronan agent, e.g. a PEGylated hyaluronan degrading enzyme. In another example, a corticosteroid, such as dexamethasone, is administered one hour before administration of the hyaluronan-degrading enzyme, e.g. a PEGylated hyaluronan degrading enzyme and eight to twelve hours after administration of the anti-hyaluronan agent, e.g. a PEGylated hyaluronan degrading enzyme.

Any dosing regime is contemplated as long as the time of dosing of the corticosteroid ameliorates the one or more side effects associated with administration of the hyaluronan-degrading enzyme, for example a PEGylated hyaluronidase. In addition, the dose or dosing regime of corticosteroid is one that does not interfere or reduce the therapeutic effect of the hyaluronan-degrading enzyme or other agent in the compositions and combinations provided herein, including in treating a cancer or solid tumor.

b. Anti-Cancer Agents and Other Treatments

The combination therapy provided herein can be used alone or in further combination with other anti-cancer agents. The anti-cancer agent(s) or treatment(s) can be surgery, radiation, drugs, chemotherapeutics, polypeptides, antibodies, peptides, small molecules or gene therapy vectors, viruses or DNA.

Exemplary anti-cancer agents that can be administered after, coincident with or before administration of the combination therepy herein, include, but are not limited to Acivicins; Avicin; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones;

Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Flurocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/ Tiuxetans; Idarubicins; Ifosfamides; Ilmofosines; Ilomastats; Imatinib mesylates; Imexons; Improsulfans; Indisulams; Inproquones; Interferon alfa-2as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; MelphalansIL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofirans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; TeniposidesNM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars, for example:

Aldesleukins (e.g. PROLEUKIN®); Alemtuzumabs (e.g. CAMPATH®); Alitretinoins (e.g. PANRETIN®); Allopurinols (e.g. ZYLOPRIM®); Altretamines (e.g. HEXALEN®); Amifostines (e.g. ETHYOL®); Anastrozoles (e.g. ARIMIDEX®); Arsenic Trioxides (e.g. TRISENOX®); Asparaginases (e.g. ELSPAR®); BCG Live (e.g. TICE® BCG); Bexarotenes (e.g. TARGRETIN®); Bevacizumab (AVASTIN®); Bleomycins (e.g. BLENOXANE®); Busulfan intravenous (e.g. BUSULFEX®); Busulfan orals (e.g. MYLERAN®); Calusterones (e.g. METHOSARB®); Capecitabines (e.g. XELODA®); Carboplatins (e.g. PARAPLATIN®); Carmustines (e.g. BCNU®, BiCNU®); Carmustines with Polifeprosans (e.g. GLIADEL® Wafer); Celecoxibs (e.g. CELEBREX®); Chlorambucils (e.g. LEUKERAN®); Cisplatins (e.g. PLATINOL®); Cladribines (e.g. LEUSTATIN®, 2-CdA®); Cyclophosphamides (e.g. CYTOXAN®, NEOSAR®); Cytarabines (e.g. CYTOSAR-U®); Cytarabine liposomals (e.g. DepoCyt®); Dacarbazines (e.g. DTIC-Dome): Dactinomycins (e.g. COSMEGEN®); Darbepoetin Alfas (e.g. ARANESP®); Daunorubicin liposomals (e.g. DANUOXOME®); Daunorubicins/Daunomycins (e.g. CERUBIDINE®); Denileukin Diftitoxes (e.g. ONTAK®); Dexrazoxanes (e.g. ZINECARD®); Docetaxels (e.g. TAXOTERE®); Doxorubicins (e.g. ADRIAMYCIN®, RUBEX®); Doxorubicin liposomals, including Doxorubicin HCL liposome injections (e.g. DOXIL®); Dromostanolone propionates (e.g. DROMOSTANOLONE® and MASTERONE® Injection); Elliott's B Solutions (e.g. Elliott's B Solution®); Epirubicins (e.g. ELLENCE®); Epoetin alfas (e.g. EPOGEN®); Estramustines (e.g. EMCYT®); Etoposide phosphates (e.g. ETOPOPHOS®); Etoposide VP-16s (e.g. VEPESID®); Exemestanes (e.g. AROMA- SIN®); Filgrastims (e.g. NEUPOGEN®); Floxuridines (e.g. FUDR®); Fludarabines (e.g. FLUDARA®); Fluorouracils incl. 5-FUs (e.g. ADRUCIL®); Fulvestrants (e.g. FASLODEX®); Gemcitabines (e.g. GEMZAR®); Gemtuzumabs/Ozogamicins (e.g. MYLOTARG®); Goserelin acetates (e.g. ZOLADEX®); Hydroxyureas (e.g. HYDREA®); Ibritumomabs/Tiuxetans (e.g. ZEVALIN®); Idarubicins (e.g. IDAMYCIN®); Ifosfamides (e.g. IFEX®); Imatinib mesylates (e.g. GLEEVEC®); Interferon alfa-2 as (e.g. ROFERON-A®); Interferon alfa-2bs (e.g. INTRON AC)); Irinotecans (e.g. CAMPTOSAR®); Letrozoles (e.g. FEMARA®); Leucovorins (e.g. WELLCOVORIN®, LEUCOVORIN®); Levamisoles (e.g. ERGAMISOL®); Lomustines/CCNUs (e.g. CeeBU®); Mechlorethamines/Nitrogen mustards (e.g. MUSTARGEN®); Megestrol acetates (e.g. MEGACE®); Melphalans/L-PAMs (e.g. ALKERAN®); Mercaptopurine, including 6-mercaptopurines (6-MPs; e.g. PURINETHOL®); Mesnas (e.g. MESNEX®); Methotrexates; Methoxsalens (e.g. UVADEX®); Mitomycin Cs (e.g. MUTAMYCIN®, MITOZYTREX®); Mitotanes (e.g. LYSODREN®); Mitoxantrones (e.g. NOVANTRONE®); Nandrolone Phenpropionates (e.g. DURABOLIN-50®); Nofetumomabs (e.g. VERLUMA®); Oprelvekins (e.g. NEUMEGA®); Oxaliplatins (e.g. ELOXATIN®); Paclitaxels (e.g. PAXENE®, TAXOL®); Pamidronates (e.g. AREDIA®); Pegademases (e.g. ADAGEN®); Pegaspargases (e.g. ONCASPAR®); Pegfilgrastims (e.g. NEULASTA®); Pentostatins (e.g. NIPENT®); Pipobromans (e.g. VERCYTE®); Plicamycin/Mithramycins (e.g. MITHRACIN®); Porfimer sodiums (e.g. PHOTOFRIN®); Procarbazines (e.g. MATULANE®); Quinacrines (e.g. ATABRINE®); Rasburicases (e.g. ELITEKC)); Rituximabs (e.g. RITUXANC)); Sargramostims (e.g. PROKINE®); Streptozocins (e.g. ZANOSAR®); Sunitinib Malates (e.g. SUTENT®); Talcs (e.g. SCLEROSOL®); Tamoxifens (e.g. NOLVADEX®); Temozolomides (e.g. TEMODAR®); Teniposides/VM-26s (e.g. VUMON®); Testolactones (e.g. TESLAC®); Thioguanines including, 6-thioguanine (6-TG); Thiotepas (e.g. THIOPLEX®); Topotecans (e.g. HYCAMTIN®); Toremifenes (e.g. FARESTON®); Tositumomabs (e.g. BEXXAR®); Trastuzumabs (e.g. HERCEPTIN®); Tretinoins/ATRA (e.g. VESANOID®); Uracil Mustards; Valrubicins (e.g. VALSTAR®); Vinblastines (e.g. VELBAN®); Vincristines (e.g. ONCOVIN®); Vinorelbines (e.g. NAVELBINE®); and Zoledronates (e.g. ZOMETA®).

H. Examples

The following examples are included for illustrative purposes only and are not intended to limit the scope of the invention.

EXAMPLE 1

Antitumor Effect of PEGPH20 and Nab-Paclitaxel Combination Treatment in a Human Pancreatic Tumor Xenograft Model A human pancreatic cancer xenograft model was evaluated for antitumor effects of PEGPH20 in combination with nanoparticle albumin-bound (nab)-paclitaxel.

Tumor cells from the BxPC3 pancreatic cancer cell line (American Tissue Culture Collection (ATCC)CRL-1687) were grown to approximately 80% confluency, trypsinized, collected, washed once in HBSS (Hank's balance salt solution, Mediatech Inc.). Prior to inoculation cells were washed twice with sterile HBSS, counted using a Nexcelom Cellometer (Nexcelom Bioscience; Lawrence, Mass.) automated counting device which determines cell concentration and viability via Trypan Blue exclusion and diluted with HBSS to a concentration of $1\times10^8$ cells/mL on ice before inoculation into animals. Male nude mice (Athymic NCr nu/nu mice, Taconic Laboratories, Inc.) approximately 6 weeks old, were inoculated intramuscularly (IM) with 0.05 mL of cell suspension, peritibially, in the left hind leg (adjacent to the tibia periosteum). The tumors in the animals were assessed twice a week and allowed to grow to a mean tumor volume of approximately 350-400 mm$^3$. Actual tumor volumes were determined using VisualSonics Vevo 770 high-resolution ultrasound (VisulaSonics Inc.; Toronto, Ontario, Canada).

Tumor-bearing animals were grouped into 8 treatment groups of 8 animals per group and treated intravenously with: 1) vehicle (API buffer; 2) PEGPH20 (4.5 mg/kg); 3) nab-paclitaxel (3 mg/kg; low dose); 4) nab-paclitaxel (10 mg/kg; moderate dose); 5) nab-paclitaxel (30 mg/kg; high dose); 6) PEGPH20 (4.5 mg/kg)+nab-paclitaxel (3 mg/kg); 7) PEGPH20 (4.5 mg/kg)+nab-paclitaxel (10 mg/kg); or 8) PEGPH20 (4.5 mg/kg)+nab-paclitaxel (30 mg/kg). PEGPH20 and nab-paclitaxel were administered separately. PEGPH20 was administered first immediately followed by nab-paclitaxel. The dose and frequency of the treatments was every 3 days for a total of 6 injections starting on Day 0 with a dose volume of 0.1 mL/25 g mouse, or 4.0 mL/kg (i.e. Days 0, 3, 6, 9, 12, 15).

The tumor volumes of all mice were measured by capturing images using the VisualSonics ultrasound system 2 times per week. Tumor volume was calculated using a 3D-mode imaging software program (VisualSonics® Vevo 770®, v 3.0.0). The percent tumor growth inhibition (% TGI) was calculated by the following equation:

$$[1-(T_n-T_0)/(C_n-C_0)]\times100\%$$

In the above equation, $T_n$ is the average tumor volume in the treatment group at respective day "n" at the indicated timepoint after treatment; $T_0$ is the average tumor volume in the treatment group at Day 0 before treatment; $C_n$ is the average tumor volume in the control group at respective day "n" at the indicated timepoint after treatment with vehicle; and $C_0$ is the average tumor volume in the control group at Day 0 before treatment.

The results are depicted in FIG. 1. The results show that nab-paclitaxel at high and moderate doses inhibited tumor growth, which was enhanced in the presence of PEGPH20. For example, at the last time point where tumor volume was measured, moderate to high doses of nab-paclitaxel (10 mg/kg and 30 mg/kg) inhibited tumor growth by 62% (p<0.01) and 74% (p<0.01), respectively, compared to vehicle control. In the presence of PEGPH20, tumor growth inhibition for the 10 mg/kg dose treatment groups of nab-palitaxel was increased to 72% (p<0.01) and for the 30 mg/kg dose treatment groups of nab-palitaxel was increased to 91% (p<0.01). This is a PEGPH20-mediated increase in efficacy of 19% for the moderate nab-palitaxel dose, and 26% for the high nab-palitaxel dose. No substantial tumor growth inhibition was observed in groups treated with 4.5 mg/mg PEGPH20 or in groups treated with 3 mg/kg low dose nab-paclitaxel in the presence or absence of PEGPH20.

EXAMPLE 2

Figure 2:
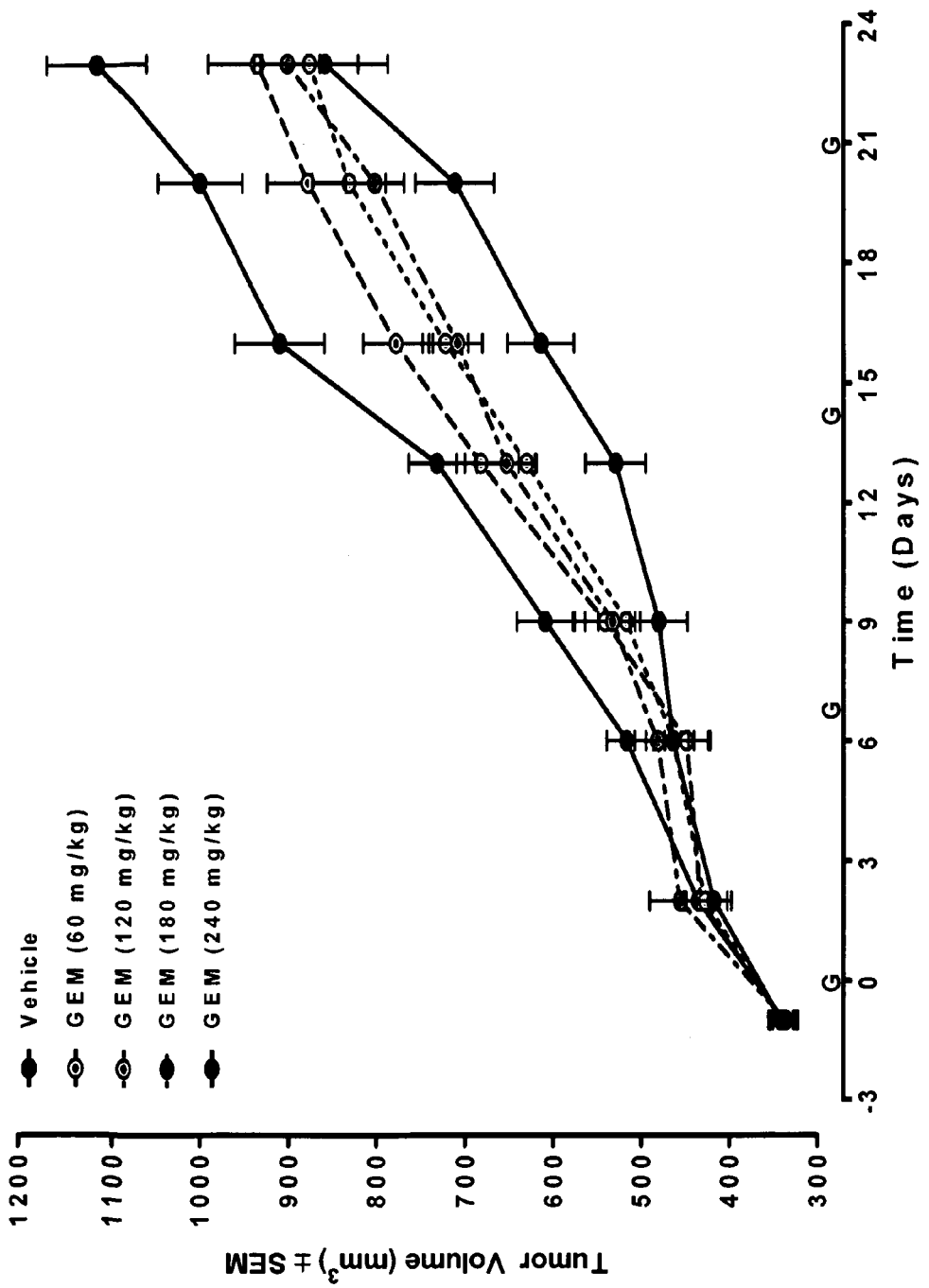
FIG. 2 depicts the effects of administering varying doses of gemcitabine (GEM) on tumor growth in a mouse BxPC-3 PDA tumor xenograft model.

Antitumor Effect of PEGPH20, Nab-Paclitaxel and Gemcitabine Combination Treatment in a Human Pancreatic Tumor Xenograft Model A. Tumor Growth Inhibition The human pancreatic cancer xenograft model described in Example 1 was used to evaluate the antitumor effects of PEGPH20 and nab-paclitaxel combination therapy in further combination with gemcitabine treatment. Prior to performing the study, a route and dose level for gemcitabine was selected based. To do this tumor-bearing mice were treated with varying doses of gemcitabine (60 mg/kg, 120 mg/kg, 180 mg/kg and 240 mg/kg) once a week for 21 days (day 0, 7, 14 and 21) and tumor volume was monitored as described above. The results are depicted in FIG. 2. The results show that gemcitabine inhibited tumor growth at all doses tested compared to vehicle only. A sub-optimal dose of 180 mg/kg was selected for use in subsequent PEGPH20 combinatorial chemotherapeutic studies. Sub-optimal doses of both gemcitabine and nab-paclitaxel were selected to evaluate the potential benefits of combining the three anti-cancer agents: PEGPH20, gemcitabine and nab-paclitaxel.

Tumor-bearing mice were grouped into 8 treatment groups of 12 animals per group and treated with: 1) vehicle (API buffer); 2) PEGPH20 (4.5 mg/kg); 3) nab-paclitaxel (10 mg/kg); 4) gemcitabine (180 mg/kg); 5) PEGPH20 (4.5 mg/kg)+nab-paclitaxel (10 mg/kg); 6) PEGPH20 (4.5 mg/kg)+gemcitabine (180 mg/kg); 7) nab-paclitaxel (10 mg/kg)+gemcitabine (180 mg/kg); or 8) PEGPH20 (4.5 mg/kg)+nab-paclitaxel (10 mg/kg)+gemcitabine (180 mg/kg). The PEGPH20 and nab-paclitaxel were administered intravenously and the dose and frequency of treatments was 2 times per week (2×/wk) for a four week dose cycle. Gemcitabine was administered intraperitoneally 24 hours after PEGPH20 and/or nab-paclitaxel every 7 days for three weeks of the dose cycle. Depending on the tested group, the dosing schedule for administration of the agents in a four week cycle is set forth in Table 5.

TABLE 5

Dosing Schedule

| Schedule | Treatment |
| --- | --- |
| Day 0 | vehicle or PEGPH20 ± nab-paclitaxel (each intravenous) |
| Day 1 (24 hours after day 0 administration) | gemcitabine (intraperitoneal) |
| Day 4 | vehicle or PEGPH20 ± nab-paclitaxel (each intravenous) |
| Day 7 | vehicle or PEGPH20 ± nab-paclitaxel (each intravenous) |
| Day 8 (24 hours after day 7 administration) | gemcitabine (intraperitoneal) |
| Day 11 | vehicle or PEGPH20 ± nab-paclitaxel (each intravenous) |
| Day 14 | vehicle or PEGPH20 ± nab-paclitaxel (each intravenous) |
| Day 15 (24 hours after day 14 administration) | gemcitabine (intraperitoneal) |
| Day 18 | vehicle or PEGPH20 ± nab-paclitaxel (each intravenous) |
| Day 21 | vehicle or PEGPH20 ± nab-paclitaxel (each intravenous) |
| Day 25 | vehicle or PEGPH20 ± nab-paclitaxel (each intravenous) |

Figure 3:
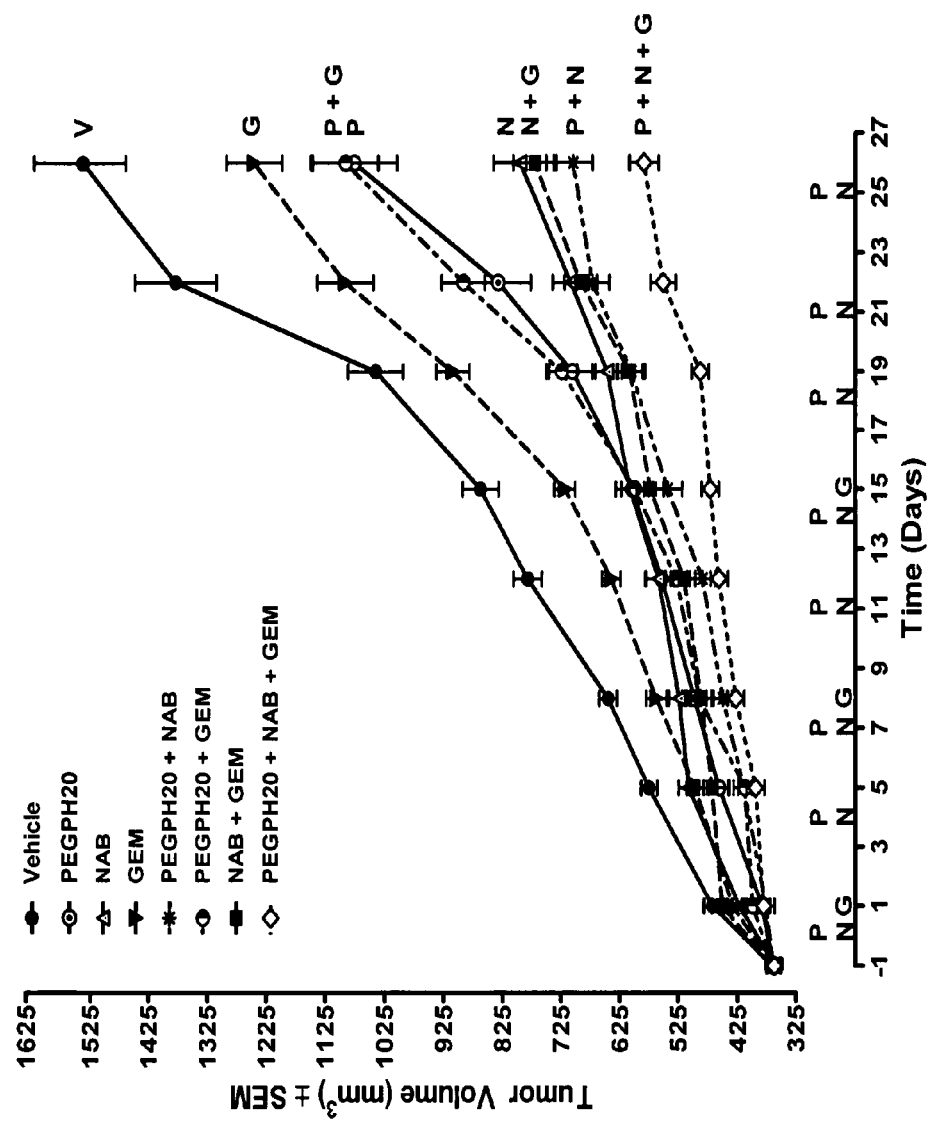
FIG. 3 depicts the effect of PEGPH20 (P), gemcitabine (GEM, G) and/or nab-paclitaxel (NAB, N) on tumor growth in a mouse BxPC-3 PDA tumor xenograft model.

Tumor volume and tumor growth inhibition were determined as described in Example 1. The results are depicted in FIG. 3. The results show that gemcitabine alone, PEGPH20 alone and PEGPH20+gemcitabine exhibited some antitumor activity, but that the antitumor effect was much greater in therapies containing nab-paclitaxel with the greatest antitumor effect exhibited in animals treated with PEGPH20, nab-paclitaxel and gemcitabine. Table 6 depicts the results as the percentage growth inhibition relative to vehicle as determined from tumor volume measurements at day 26. The results show that treating animals with PEGPH20 in addition to treatment with nab-paclitaxel and gemcitabine resulted in 81% tumor growth inhibition relative to vehicle, while nab-paclitaxel and gemcitabine treatment without PEGPH20 only resulted in a 66% tumor growth inhibition. Thus, the results show that the PEGPH20 addition to nab-paclitaxel and gemcitabine combination therapy resulted in a 23% increase in efficacy.

TABLE 6

Antitumor Effect of PEGPH20 in combination with gemcitabine and/or nab-paclitaxel

| Treatment | Tumor Growth Inhibition (% of vehicle control) | p-value (relative to vehicle control) |
| --- | --- | --- |
| gemcitabine | 25 | 0.0110 |
| PEGPH20 + gemcitabine | 38 | <0.0001 |
| PEGPH20 | 39 | <0.0028 |
| nab-paclitaxel | 63 | <0.0001 |
| nab-paclitaxel + gemcitabine | 66 | <0.0001 |
| PEGPH20 + nab-paclitaxel | 71 | <0.0001 |
| PEGPH20 + nab-paclitaxel + gemcitabine | 81 | <0.0001 |

B. Median Survival Time

Following the first four week dosing cycle as set forth in part A, the dosing cycle was repeated two times and time to survival endpoint was followed over time. Briefly, in each dosing cycle, animals were treated with vehicle or PEGPH20 (4.5 mg/mL) with or without nab-paclitaxel (10 mg/kg) intravenously twice a week for four weeks. In each cycle, groups receiving gemcitabine were administered gemcitabine (180 mg/kg) 24 hours after PEGPH20 and/or nab-paclitaxel every 7 days for three weeks of the dose cycle. Time to survival endpoint, a surrogate of animal survival, was defined as (a) time to tumor volume of greater than 2000 mm$^3$, (b) time to a greater than 20% bodyweight loss, or (c) time to animal duress or death.

Figure 4:
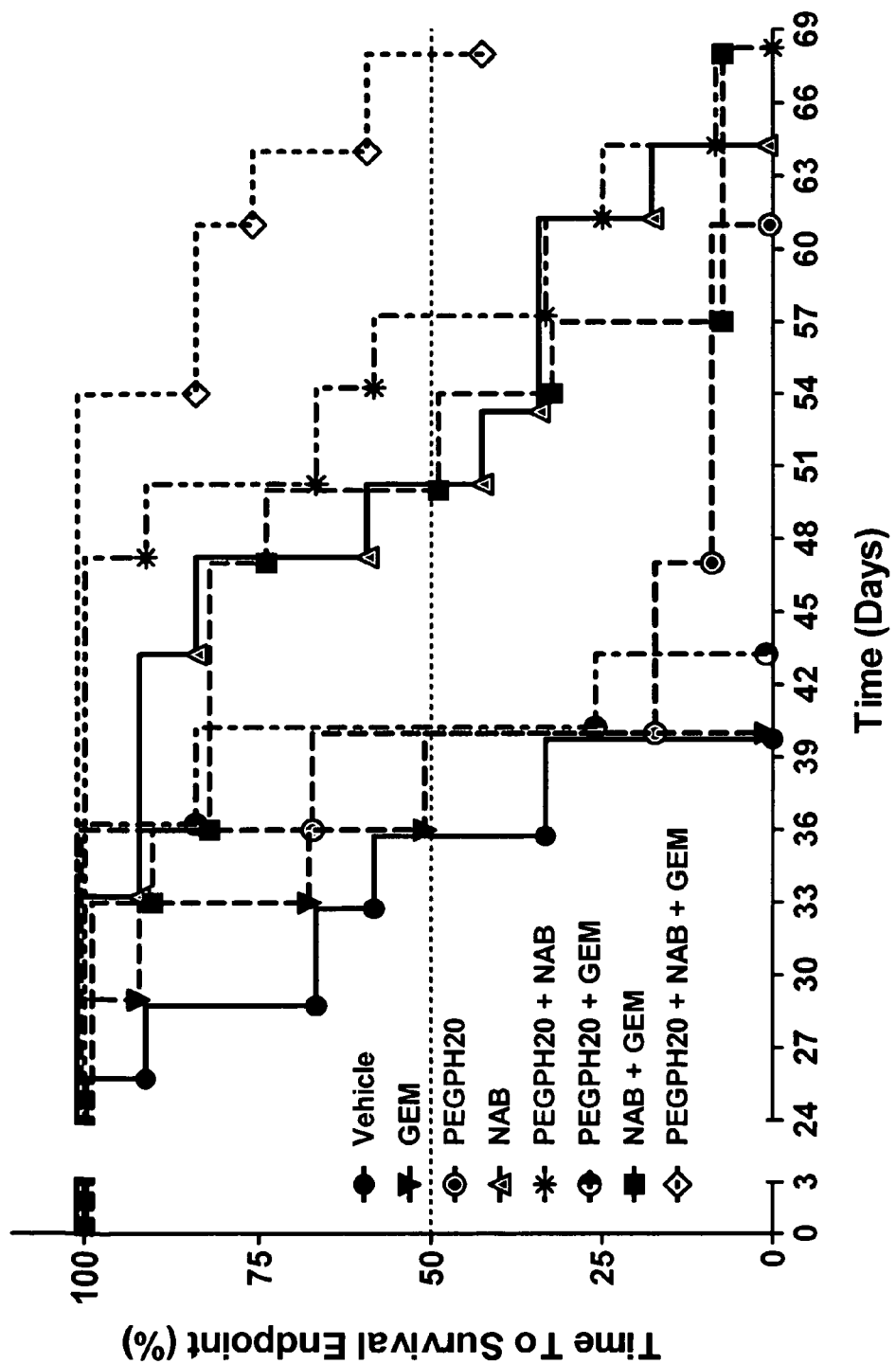
FIG. 4 depicts the median survival time of mice treated with PEGPH20 (P), gemcitabine (GEM, G) and/or nab-paclitaxel (NAB, N) in a mouse BxPC-3 PDA tumor xenograft model.

The results are set forth in FIG. 4 and Table 7. The results show that median survival time to endpoint of animals treated only with gemcitabine was 38 days, animals treated with nab-paclitaxel and gemcitabine was 52 days and animals treated with PEGPH20, nab-paclitaxel and gemcitabine was 68 days. Thus, the results show that the addition of PEGPH20 to treatment with nab-paclitaxel and gemcitabine increased median survival time compared to any other treatment with an increased efficacy of 31% compared to treatment with nab-paclitaxel and gemcitabine without PEGPH20 and an increased efficacy of 79% compared to treatment with only gemcitabine.

TABLE 7

Median Survival Time

| Treatment | Median Survival Time (days) |
| --- | --- |
| gemcitabine | 38 |
| nab-paclitaxel + gemcitabine | 52 |
| PEGPH20 + nab-paclitaxel + gemcitabine | 68*‡ |

*Relative to vehicle (p < 0.0001)
‡Relative to nab-paclitaxel + gemcitabine (p = 0.0008)

C. Measurement of Tumor Biomarkers

Biomarkers carbohydrate antigen 19-9 (CA19-9) and carcinoembryonic antigen (CEA) associated with pancreatic cancer were tested to measure therapeutic response. Animals were treated as described in part A. Serum was collected from satellite animals (n<3) from each group on day 0, 6, 13 and 20 of the first dosing cycle. Human CA19-9 was measured using a CA 19-9 ELISA kit (Catalog No. CA199T, Calbiotech, Spring Valley, Calif.) and CEA tumor antigen was measured using a CEA ELISA kit (Catalog No. CE062T, Calbiotech, Spring Valley, Calif.).

Figure 5A:
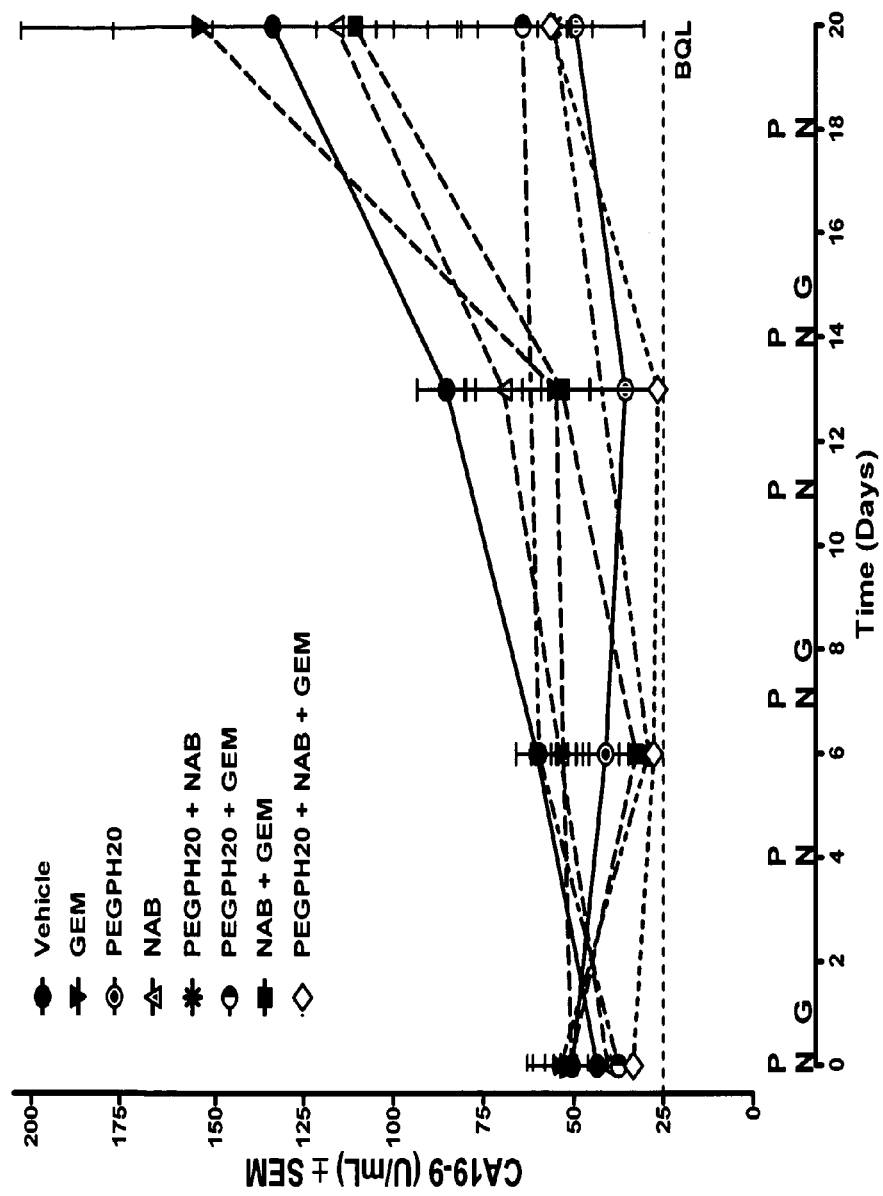
FIG. 5 (A-B) depicts the levels of CA 19-9 (FIG. 5A) and CEA marker (FIG. 5B) from serum of mice treated with PEGPH20 (P), gemcitabine (GEM, G) and/or nab-paclitaxel (NAB, N) in a mouse BxPC-3 PDA tumor xenograft model.
Figure 5B:
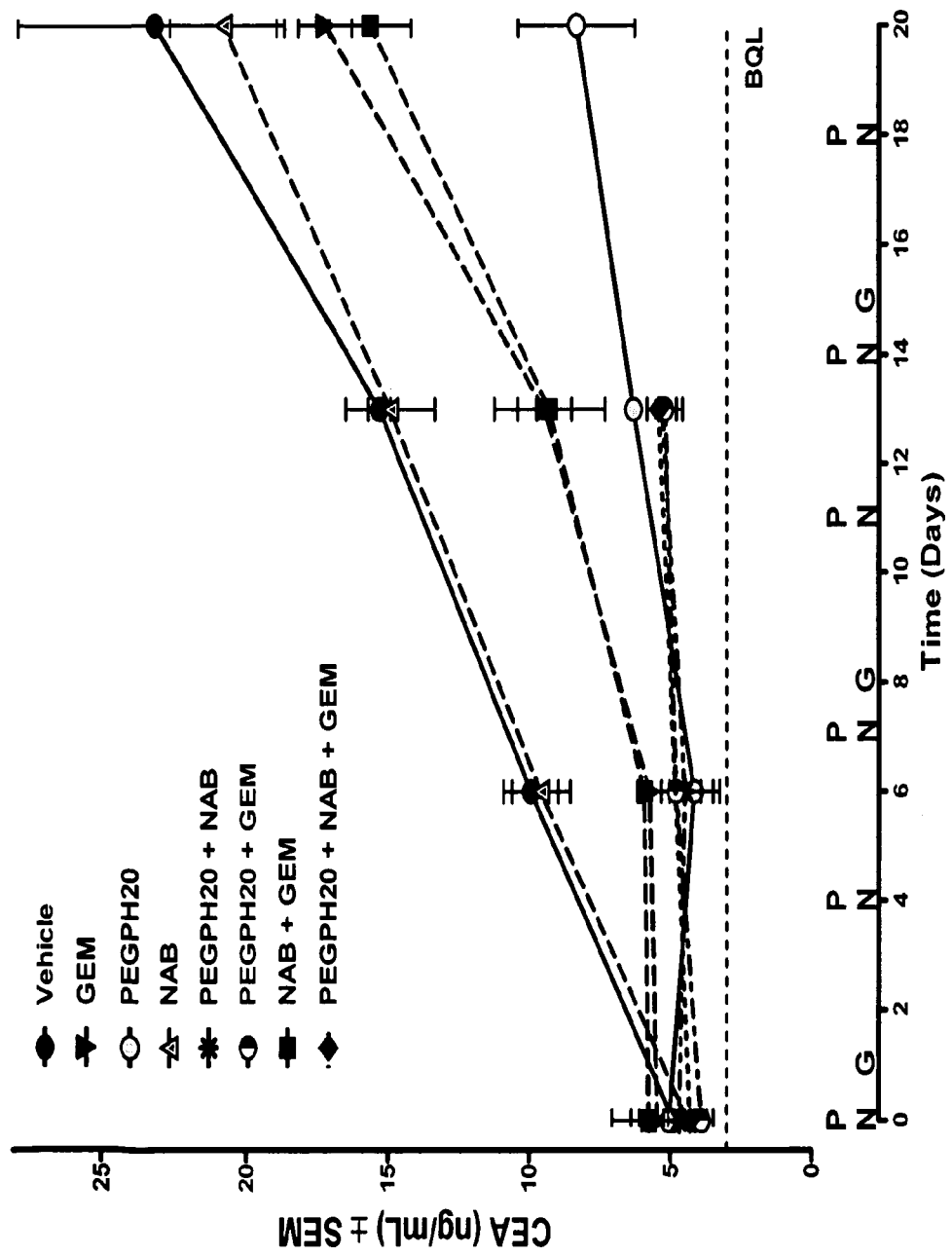

The results are set forth in FIG. 5 (A-B). The results show that the presence of PEGPH20 treatment resulted in a reduction of the measured markers in all treatment groups. For example, at day 20, the level of CA 19-9 marker detected was similar in all groups treated with PEGPH20 ranging from approximately 40-60 U/mL. In contrast, the level of CA19-9 marker in animals treated with nab-paclitaxel or nab-paclitaxel+gemcitabine was approximately double that of animals also treated with PEGPH20 and was approximately 110 U/mL. Animals treated only with gemcitabine exhibited CA 19-9 levels that were approximately similar to vehicle only control. Hence, the results show that animals treated with PEGPH20+nab-paclitaxel had reduced CA19-9 levels compared to animals treated only with nab-paclitaxel; animals treated with PEGPH20+gemcitabine had reduced CA19-9 levels compared to animals treated only with gemcitabine; and animals treated with PEGPH20+nab-paclitaxel+gemcitabine had reduced CA 19-9 levels compared to animals treated only with nab-paclitaxel+gemcitabine. For animals treated with PEGPH20+nab-paclitaxel+gemcitabine, the CA19-9 was reduced 49% compared to animals treated with nab-paclitaxel+gemcitabine in the absence of PEGPH20.

The results were similar when CEA marker was measured. Using this marker, the results show that the levels of CEA were not substantially changed at day 20 in animals treated only with nab-paclitaxel compared to vehicle control as CEA was measured at approximately 20 to 25 ng/mL in these groups. In animals treated with gemcitabine or nab-paclitaxel+gemcitabine there was some reduction in the measured CEA marker at day 20 to approximately 15 ng/mL. In the presence of PEGPH20, the level of the marker that was measured was considerably reduced compared to the treatment groups without PEGPH20. For example, in animals treated only with PEGPH20, the measured CEA at day 20 was approximately 7-8 ng/mL. In animals treated with PEGPH20+gemcitabine, PEGPH20+nab-paclitaxel, or PEGPH20+nab-paclitaxel+gemcitabine, the levels of CEA at day 20 were too low to quantitate by ELISA.

EXAMPLE 3 rHuPH20 Expressing Cell Lines

A. Generation of an Initial Soluble rHuPH20-Expressing Cell Line

Chinese Hamster Ovary (CHO) cells were transfected with the HZ24 plasmid (set forth in SEQ ID NO:52). The HZ24 plasmid vector for expression of soluble rHuPH20 contains a pCI vector backbone (Promega), DNA encoding amino acids 1-482 of human PH20 hyaluronidase (SEQ ID NO:49), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:1), followed by a BamHI restriction site. The construct pCI-PH20-IRES-DHFR-SV40pa (HZ24), therefore, results in a single mRNA species driven by the CMV promoter that encodes amino acids 1-482 of human PH20 (set forth in SEQ ID NO:3) and amino acids 1-186 of mouse dihydrofolate reductase (set forth in SEQ ID NO:53), separated by the internal ribosomal entry site (IRES).

Non-transfected CHO cells growing in GIBCO Modified CD-CHO media for DHFR(-) cells, supplemented with 4 mM Glutamine and 18 ml/L Pluronic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected CHO cells were tested for viability prior to transfection.

Sixty million viable cells of the non-transfected CHO cell culture were pelleted and resuspended to a density of $2 \times 10^7$ cells in 0.7 mL of 2× transfection buffer (2×HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 µg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 µF or at 350 V and 960 µF.

The cells were removed from the cuvettes after electroporation and transferred into 5 mL of Modified CD-CHO media for DHFR(-) cells, supplemented with 4 mM Glutamine and 18 ml/L Pluronic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity using the microturbidity assay described in Example 6. Cells expressing the highest levels of hyaluronidase activity were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate. Six of these HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment). Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate in shaker flasks and gave rise to clones producing in excess of 1,000 Units/ml hyaluronidase activity (clone 3D35M; or Gen1 3D35M). A master cell bank (MCB) of the 3D35M cells was then prepared B. Generation of a Second Generation Cell Line Expressing Soluble rHuPH20

The Gen1 3D35M cell line described in Example 3A was adapted to higher methotrexate levels to produce generation 2 (Gen2) clones. 3D35M cells were seeded from established methotrexate-containing cultures into CD CHO medium containing 4 mM GlutaMAX-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the $12^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the $8^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr-) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of ~7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III. Sequence analysis of the mRNA transcript indicated that the derived cDNA (SEQ ID NO:56) was identical to the reference sequence (SEQ ID NO:49) except for one base pair difference at position 1131, which was observed to be a thymidine (T) instead of the expected cytosine (C). This is a silent mutation, with no effect on the amino acid sequence.

EXAMPLE 4

Production and Purification of rHuPH20

A. Production of Gen2 Soluble rHuPH20 in 300 L Bioreactor Cell Culture

A vial of HZ24-2B2 cells (Example 3B) was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, a vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 106$ cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of $4.0 \times 10^5$ viable cells per ml and a total volume of 260 L. Parameters were temperature set point, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (lx CD-CHO+33 g/L Glucose+33 mL/L Glutamax1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and viral in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 μm and a layer of diatomaceous earth graded to 1.4-1.1 μm, followed by a cellulose membrane, then through a second single Millistak filtration system (Millipore) containing a layer of diatomaceous earth graded to 0.4-0.11 μm and a layer of diatomaceous earth graded to <0.1 μm, followed by a cellulose membrane, and then through a 0.22 μm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filters (Sartorius), followed by a 10× buffer exchange with 10 mM Tris, 20 mM $Na_2SO_4$, pH 7.5 into a 0.22 μm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM $Na_2SO_4$, pH 7.5. Following viral inactivation, the concentrated, diafiltered harvest (Example 4A) was loaded onto the Q column at a flow rate of 100 cm/hr. The column was washed with 5 column volumes of 10 mM Tris, 20 mM $Na_2SO_4$, pH 7.5 and 10 mM Hepes, 50 mM NaCl, pH 7.0. The protein was eluted with 10 mM Hepes, 400 mM NaCl, pH 7.0 into a 0.22 μm final filter into sterile bag. The eluate sample was tested for bioburden, protein concentration and hyaluronidase activity. $A_{280}$ absorbance readings were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2 M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM $CaCl_2$ pH 7.0 at 100 cm/hr and the wash was added to the collected flow thru. Combined with the column wash, the flow through was passed through a 0.22 μm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 μm final filter into a sterile bag. The viral filtered sample was tested for protein concentration, enzyme activity, oligosaccharide, monosaccharide and sialic acid profiling. The sample also was tested for process related impurities.

EXAMPLE 5

Preparation of PEGylated rHuPH20

In this example, rHuPH20 was PEGylated by reaction of the enzyme with linear N-hydroxysuccinimidyl ester of methoxy poly(ethylene glycol) butanoic acid (mPEG-SBA-30K).

A. Preparation of mPEG-SBA-30K

In order to generate PEGPH20, rHuPH20 (which is approximately 60 KDa in size) was covalently conjugated to a linear N-hydroxysuccinimidyl ester of methoxy poly(ethylene glycol) butanoic acid (mPEG-SBA-30K), having an approximate molecular weight of 30 kDa. The structure of mPEG-SBA is shown below, where n≈681.

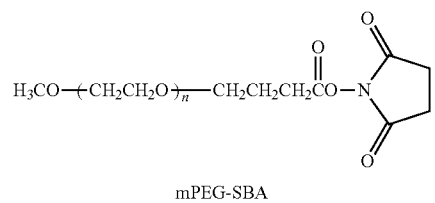

mPEG-SBA

Methods used to prepare the mPEG-SBA-30K that was used to PEGylate rHuPH20 are described, for example, in U.S. Pat. No. 5,672,662. Briefly, the mPEG-SBA-30K is made according to the following procedure:

A solution of ethyl malonate (2 equivalents) dissolved in dioxane is added drop by drop to sodium hydride (2 equivalents) and toluene under a nitrogen atmosphere. mPEG methane sulfonate (1 equivalent, MW 30 Wa, Shearwater) is dissolved in toluene and added to the above mixture. The resulting mixture is refluxed for approximately 18 hours. The reaction mixture is concentrated to half its original volume, extracted with 10% aqueous NaCl solution, extracted with 1% aqueous hydrochloric acid, and the aqueous extracts are combined. The collected aqueous layers are extracted with dichloromethane (3×) and the organic layer is dried with magnesium sulfate, filtered and evaporated to dryness. The resulting residue is dissolved in 1N sodium hydroxide containing sodium chloride and the mixture is stirred for 1 hour. The pH of the mixture is adjusted to approximately 3 by addition of 6N hydrochloric acid. The mixture is extracted with dichloromethane (2×).

The organic layer is dried over magnesium sulfate, filtered, concentrated, and poured into cold diethyl ether. The precipitate is collected by filtration and dried under vacuum. The resulting compound is dissolved in dioxane and refluxed for 8 hours and then concentrated to dryness. The resulting residue is dissolved in water and extracted with dichloromethane (2×), dried over magnesium sulfate, and the solution is concentrated by rotary evaporation and then poured into cold diethyl ether. The precipitate is collected by filtration and dried under vacuum. The resulting compound (1 equivalent) is dissolved in dichloromethane and N-hydroxysuccinimide (2.1 equivalents) is added. The solution is cooled to 0° C. and a solution of dicyclohexylcarbodiimide (2.1 equivalents) in dichloromethane is added dropwise. The solution is stirred at room temperature for approximately 18 hours. The reaction mixture is filtered, concentrated and precipitated in diethyl ether. The precipitate is collected by filtration and dried under vacuum to afford the powder mPEG-SBA-30K which is then frozen at ≤−15° C.

B. Conjugation of mPEG-SBA-30K to rHuPH20

To make the PEGPH20, mPEG-SBA-30K was coupled to the amino group(s) of rHuPH20 by covalent conjugation, providing stable amide bonds between rHuPH20 and mPEG, as shown below, where n≈681.

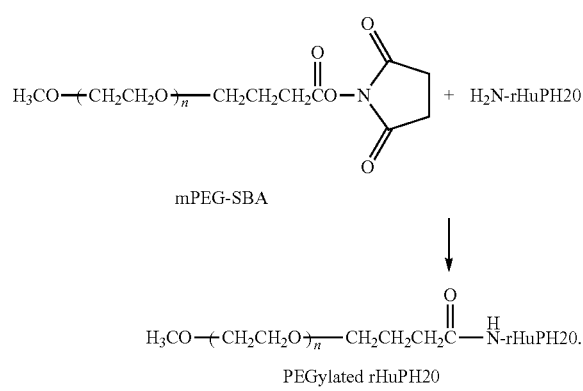

mPEG-SBA

PEGylated rHuPH20

Prior to congutation, the rHuPH20 purified bulk protein made in Example 4B was concentrated to 10 mg/mL, using a 10 kDa polyethersulfone (PES) tangential flow filtration (TFF) cassettes (Sartorius) with a 0.2 m² filtration area, and buffer exchanged against 70 mM Potassium Phosphate at pH 7.2. The concentrated protein was then stored at 2-8° C. until use.

To congugate the rHuPH20, the mPEG-SBA-30K (Nektar) was thawed at room temperature in the dark for not longer than 2 hours. Depending on the batch size, a sterile 3" stir bar was placed into a 1 or 3 liter Erlenmeyer flask and buffer exchanged rHuPH20 protein was added. Five grams of dry mPEG-SBA-30K powder per gram of rHuPH20 (10:1 molar ratio of mPEG-SBA-30K: rHuPH20) was added to the flask under a vacuum hood and the mixture was mixed for 10 minutes or until the mPEG-SBA-30K was complete dissolved. The stir rate was set such that vortexing occurred without foaming.

The solution was then filtered under a class 100 hood by pumping the solution, via peristaltic pump, through a 0.22 μm polystyrene, cellulose acetate filter capsule (Corning 50 mL Tubetop filter) into a new 1 or 3 liter Erlenmeyer flask containing a sterile 3" stir bar. The volume of the PEGPH20 reaction mixture was determined by mass (1 g/mL density) and the 0.22 μm filter used for filtration was examined in a post-use integrity test.

The mixture was then placed on a stir plate at 2-8° C. and mixed for 20±1 hours in the dark. The stir rate was again set such that vortexing occurred without foaming. The entire Erlenmeyer container was wrapped in foil to protect the solution from light. After mixing, the reaction was quenched by adding 1M glycine to a final concentration of 25 mM. Samples were removed from the container to test pH and conductivity. The pH and conductivity were then adjusted by adding to a solution of 5 mM Tris Base (5.65 L/L) and 5 mM Tris, 10 mM NaCl, pH 8.0 (13.35 L/L) to proceed with Q Sepharose purification.

A QFF Sepharose (GE Healthcare) ion exchange column (Height=21.5-24.0 cm, Diameter=20 cm) was prepared by equilibration with 5 column volumes (36 L) of 5 mM Tris, 10 mM NaCl, pH 8.0. The congutated product was loaded onto the QFF column at a flow rate of 95 cm/hr. The column was then washed with 11 L of equilibration buffer (5 mM Tris, 10 mM NaCl, pH 8.0) at a flow rate of 95 cm/hr followed by a wash with 25 L of equilibration buffer at a flow rate of 268 cm/hr. The protein product was then eluted with 5 mM Tris, 130 mM NaCl, pH 8.0 at a flow rate of 268 cm/hr. The resulting purified PEGPH20 was concentrated to 3.5 mg/mL, using a 30 kDa polyethersulfone (PES) tangential flow filtration (TFF) cassettes (Sartorius) with a 0.2 m² filtration area, and buffer exchanged against 10 mM Histidine, 130 mM NaCl at pH 6.5. The resulting material was tested for enzyme activity as described in Example 4 below. The PEGylated rHuPH20 material at a concentration of 3.5 mg/mL (final enzyme activity 140,000 U/mL) was filled, in 3 mL volumes, into 5 mL glass vials with a siliconized bromobutyl rubber stopper and aluminum flip-off seal, and frozen (frozen overnight in a −20° C. freezer, then put in a −80° C. freezer for longer storage). The PEGylated rHuHP20 contained approximately 4.5 moles of PEG per mole of rHuPH20.

EXAMPLE 6

Determination of Hyaluronidase Activity of Soluble rHuPH20

Hyaluronidase activity of soluble rHuPH20 in samples such as cell cultures, plasma, purification fractions and purified solutions was determined using either a turbidimetric assay, which is based on the formation of an insoluble precipitate when hyaluronic acid binds with serum albumin, or a biotinylated-hyaluronic acid substrate assay, which measures the amount of enzymatically active rHuPH20 or PEGPH20 by the digestion of biotinylated hyaluronic acid (b-HA) substrate non-covalently bound to plastic multi-well microliter plates.

A. Microturbidity Assay

Hyaluronidase activity of soluble rHuPH20 is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve.

Dilutions of the sample were prepared in Enzyme Diluent Solutions. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of sterile water for injection (SWFI), and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not less than 20 µL. The minimum sample volumes needed to perform the assay were as follows: In-process Samples, FPLC Fractions: 80 µL; Tissue Culture Supernatants: 1 mL; Concentrated Material: 80 µL; Purified or Final Step Material: 80 µL. The dilutions were made in triplicate in a Low Protein Binding 96-well plate, and 30 µL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 µL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes.

The MULTIDROP 384 was prepared to stop the reaction by priming the machine with Serum Working Solution and changing the volume setting to 240 µL (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384, and 240 µL of serum Working Solutions was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

B. Biotinylated Hyaluronan Assay

The biotinylated-hyaluronic acid assay measures the amount of enzymatically active rHuPH20 or PEGPH20 in biological samples by the digestion of a large molecular weight (~1.2 megadaltons) biotinylated hyaluronic acid (b-HA) substrate non-covalently bound to plastic multi-well microtiter plates. The rHuPH20 or PEGPH20 in standards and samples are allowed to incubate in a plate coated with b-HA at 37° C. After a series of washes, remaining uncleaved/bound b-HA is treated with Streptavidin Horseradish Peroxidase conjugate (SA-HRP). Reaction between immobilized SA-HRP and the chromogenic substrate, 3,3', 5,5'-tetramethylbenzidine (TMB), produces a blue colored solution. After stopping the reaction with acid, formation of the soluble yellow reaction product is determined by reading the absorbance at 450 nm using a microtiter plate spectrophotometer. The decrease in absorbance at 450 nm resulting from enzyme activity on the biotinylated hyaluronic acid (b-HA) substrate is a measure of the soluble rHuPH20 hyaluronidase activity. The method is performed using a calibration curve generated with dilutions of a soluble rHuPH20 or PEGPH20 reference standard, and sample activity measurements are made relative to this calibration curve.

Dilutions of the sample and calibrator were prepared in Assay Diluent. The Assay Diluent was prepared by adding 1% v/v pooled plasma (from the appropriate species) to 0.1% (w/v) BSA in HEPES, pH 7.4. This was prepared daily and stored at 2-8° C. Depending upon the species type as well as the anticipated hyaluronidase level, single or multiple dilutions were prepared to ensure at least one sample dilution would fall within the range of the calibration curve. To guide the selection of test sample dilution(s), information known about the dose of hyaluronidase administered, the route of administration, approximate plasma volume of the species and the time point were used to estimate the hyaluronidase activity levels. Each sample dilution was mixed as it was prepared by brief pulse-vortexing and pipet tips were changed in between each dilution. In general, the dilutions began with an initial 50 or 100-fold dilution followed by additional serial dilutions. A seven-point calibration curve of rHuPH20 or PEGPH20 (depending upon the treatment administered) was prepared ranging in concentration from 0.004 to 3.0 U/mL for rHuPH20 and from 0.037 to 27 U/mL for PEGPH20. One-hundred microliters (100 µL) of each test sample dilution and calibration curve point was applied to triplicate wells of a 96-well microtiter plate (Immulon 4HBX, Thermo) that had been previously coated with 100 µL per well of b-HA at 0.1 mg/mL and blocked with 250 µL of 1.0% (w/v) Bovine Serum Albumin in PBS. Plate(s) were covered with an adhesive plate seal and incubated at 37° C. for approximately 90 minutes. At the end of the incubation period, the adhesive seal was removed from the plate, samples were aspirated and the plate washed five (5) times with 300 µL per well Wash Buffer (10 mM Phosphate Buffer, 2.7 mM Potassium Chloride, 137 mM Sodium Chloride, pH 7.4, with 0.05% (v/v) Tween 20, PBST) using an automated plate washer (BioTek ELx405

Select CW, Program '4HBX1'). One hundred microliters of Streptavidin-HRP Conjugate Working Solution [Streptavidin-HRP conjugate (1:5,000 v/v) in 20 mM Tris-HCl, 137 mM Sodium Chloride, 0.025% (v/v) Tween 20, 0.1% (w/v) Bovine Serum Albumin] was added per well. The plate was sealed and allowed to incubate at ambient temperature for approximately 60 minutes without shaking and protected from light. At the end of the incubation period, the adhesive seal was removed from the plate, samples were aspirated and the plate washed five (5) times with 300 μL per well Wash Buffer as described above. TMB solution (at ambient temperature) was added to each well and allowed to incubate protected from light for approximately five (5) minutes at room temperature. TMB Stop Solution (KPL, Catalog #50-85-06) was then added as 100 μL per well. The absorbance of each well at 450 nm was determined using a microliter plate spectrophotometer. The response of the Calibration Curve on each plate was modeled using a 4-parameter logistic curve fit. The hyaluronidase activity of each unknown was calculated by interpolation from the calibration curve, corrected for sample dilution factor, and reported in U/mL.

EXAMPLE 7

Effect of PEGPH20 Treatment in a High Peritumoral Hyaluronan (HA) Tumor Model

To assess the effect of PEGPH20 on high levels of peritumoral HA, a BXPC3-Has3 tumor cell line was generated to establish an $HA^{high}$ mouse xenograft tumor model. BxPC3 cells (ATCC Cat. No. CRL-1687) were cultured under standard culture conditions using complete RPMI media. A lentiviral system was generated to express the human hyaluronan synthase 3 cDNA transcript (set forth in SEQ ID NO: 212). The generated lentiviral vector expressing hHAS3 cDNA was designated pLV-EF1a-hHAS3-IRES-Hyg and is set forth in SEQ ID NO:213. BX-PC3-Has3 stable cell line were generated by viral infection with pLV-EF1a-hHAS3-IRES-Hyg, followed by hygromycin selection. Cells infected to overexpress hHAS3 were used in all experiments.

To confirm HA levels, color intensity in the tumor section was measured with Aperio spectrum program. The tumor was graded as $HA^{High}$ at strong HA staining over 25% of tumor section; as $HA^{Moderate}$ at strong HA staining between 10 and 25% of tumor section; as $HA^{Low}$ at strong HA staining under 10% of tumor section.

NCr (nu/nu) mice that were 5 to 6 weeks old and weighed between 20-25 g were inoculated with BxPC-3-Has3 cells ($5 \times 10^6$/50 μL) adjacent to the right tibial periosteum, generating high pressure tumors. The length (L) and width (W) of the solid tumor mass were measured by caliper and the tumor volume (TV) was calculated as: $(L \times W^2)/2$. When the volume of tumors reached approximately 1500 to 2000 mm³ in diameter, mice were staged into two treatment groups: (1) BxPC3 $HA^{high}$, vehicle control or (2) BxPC3 $HA^{high}$, PEGPH20.

Animals were administered with either vehicle (10 mM Histidine, pH 6.5, 130 mM NaCl) or PEGPH20 (4.5 mg/kg) at 0 hours and again at 42 hours. With the first PEGPH20 or vehicle control treatment (at 48 hours prior to sacrifice, i.e. at t=0 hrs), animals also were treated with 240 mg/kg gemcitabine, intraperitoneally, and 10 mg/kg paclitaxel (Abraxane), intravenously. Two hours prior to sacrifice (46 hours), animals were treated intraperitoneally with HYPDXYPROBE™ (pimonidazole hydrochloride; Chemicon International, Temecula, Calif.) at 60 mg/kg and also with 0.5 mL of BrdU. Five minutes prior to sacrifice (48 hours), animals were treated intravenously with 75 μL of 0.6 mg/mL fluorescent carbocyanine dissolved in 75% DMSO 1,1'-dioctadecyl-3,3,3',3'-tetramethylindocarbocyanine perchlorate (DiI).

The animals were sacrificed at 48 hours. Whole tumors were harvested, tissues cooled to −20° C. on aluminum blocks, covered in embedding OCT medium (Sakura Finetek, Torrance, Calif.) and stored at −80° C. until sectioning. Tumor cryosections were cut into 10 μm section and processed for immunohistochemistry or imaged microscopically. Effects on vascular perfusion and tumor hypoxia were assessed.

A. Vascular Perfusion

Non-stained, fresh cryosections were scanned with a fluorescence microscope imaging system (BD CARV II Confocal Imager, Sparks, Md.; Quentem 512sc camera (Photometrics, Tucson, Ariz.); MIV2000 motorized x-y stage, and MetaMorph System, Sunnyvale, Calif.). Entire tumor sections were scanned at 10× for fluorescent carbocyanine (DiI) signal (Excitation 562 nm/emission 624 nm) to determine tumor perfusion. Images were analyzed using an Image-Pro Analyzer 7.0 (Media Cybermetrics, Bethesda, Md.). Whole tumor area and positive staining area were determined. The vascular perfusion in each tumor was calculated as percentage (signal) positive over entire tumor section.

The results are set forth in Table 8. The results show that PEG-PH20 treatment mediated dye perfusion in BxPC3-HAS3 tumors, with a significant increase in blood vessel perfusion in tumors from mice treated with PEGPH20 versus control treated tumors. As summarized in Table 8, animals treated with PEGPH20 showed an increase in vascular perfusion with a mean area of 7.24±1.78, which is a 116.9% increase over control animals.

TABLE 8

| PEGPH20-Mediated Increase in Vascular Perfusion in $HA^{high}$ tumors | | |
|---|---|---|
| Average % vascular area in whole tumor section | P | % increase |
| control (n = 7) 3.42 ± 0.53 | — | — |
| PEGPH20 (n = 6) 7.24 ± 1.78 | <0.0001 | 116.9 |

B. Hypoxia

Tumor sections from treated animals were compared for hypoxic regions by visualizing pimonidazole hydrochloride (HYPDXYPROBE™). Specifically, after sacrifice, cryosections that had been blocked with goat serum for non-specific staining were probed for 1 hour at room temperature with a 1:50 dilution of anti-pimonidazole antibody (Hypoxyprobe™-1 Mab-1, mouse $IgG_1$; Chemicon International, Temecula, Calif.) to detect pimonidazole adducts or with a 1:100 dilution anti-CD31 antibody (rat, BD Pharmingen, San Diego, Calif.) to detect endothelial cells. After washing to remove the primary reagent, either a FITC goat anti-mouse secondary antibody (to visualize Hypoxyprobe™-1 Mab-1, 1:100 dilution; Vector Labs Burlingame, Calif., USA) or a Texas Red goat anti-rat secondary antibody (to visualize CD31 endothelial cells; 1:100 dilution; Vector Labs Burlingame, Calif. USA) was used as a secondary reagent for 30 minutes at room temperature. Sections were imaged using the Image-Pro Analyzer 7.0 (Media Cybermetrics, Bethesda, Md.) Imaging System. For CD31 imaging, the excitation wavelength was 562 nm and an emission wavelength was 624 nm. For imaging for pimonidazole hydrochloride (HYPDXYPROBE™), the excitation wavelength was 490 nm and the emission wavelength was 520 nm.

The results are set forth in Table 9. The results showed that PEGPH20, which mediates HA removal, results in reduced hypoxia in BxPC3-Has3 tumors. Control animals had a mean percent hypoxic area in whole tumor section of 3.98±2.70%. Animals treated with PEGPH20 had reduced hypoxia area in tumors with a mean area of 0.86±1.07, which is a 78% decrease over control animals.

TABLE 9

PEGPH20-Mediated Decrease in Hypoxic Areas in $HA^{high}$ tumors

| | % hypoxia area in whole tumor section | P | % decrease |
|---|---|---|---|
| control (n = 7) | 3.98 ± 2.70 | — | — |
| PEGPH20 (n = 6) | 0.86 ± 1.07 | 0.035 | 78 |

EXAMPLE 8

Effect of Combinatorial PEGPH20 and nab-Paclitaxel Treatment in a High Peritumoral Hyaluronan (HA) Triple Negative Breast Cancer Tumor Model The MDA-MB-468 triple negative breast cancer (TNBC) cell line was generated to overexpress the hHAS3A cDNA transcript (SEQ ID NO: 212) and thereby establish an $HA^{high}$ TNBC model. MDA-MB-468 cells (ATCC Cat. No. HTB-132), cultured under standard culture conditions using complete RPMI medium, were infected with the hHAS3 cDNA expressing lentiviral vector pLV-EF 1a-hHAS3-IRES-Hyg (SEQ ID NO:213), described above, followed by hygromycin selection to generate the stable, hHAS3-expressing cell line MDA-MB-468/HAS3.

MDA-MB-468/HAS3 cells, suspended in RPMI were injected into nude mice. Tumor volume was measured as described above. On day 17, when the tumors reached a volume of approximately 300 mm³, the animals were divided into 6 treatment groups, which were administered 1) vehicle; 2) 1 mg/kg nab-paclitaxel; 3) 3 mg/kg nab-paclitaxel; 4) 10 mg/kg nab-paclitaxel; 5) 4.5 mg/kg PEGPH20; or 6) 1 mg/kg nab-paclitaxel and 4.5 mg/kg PEG20 intravenously. The tumor volumes were measured every 3 to 4 days for 45 days.

Figure 6A:
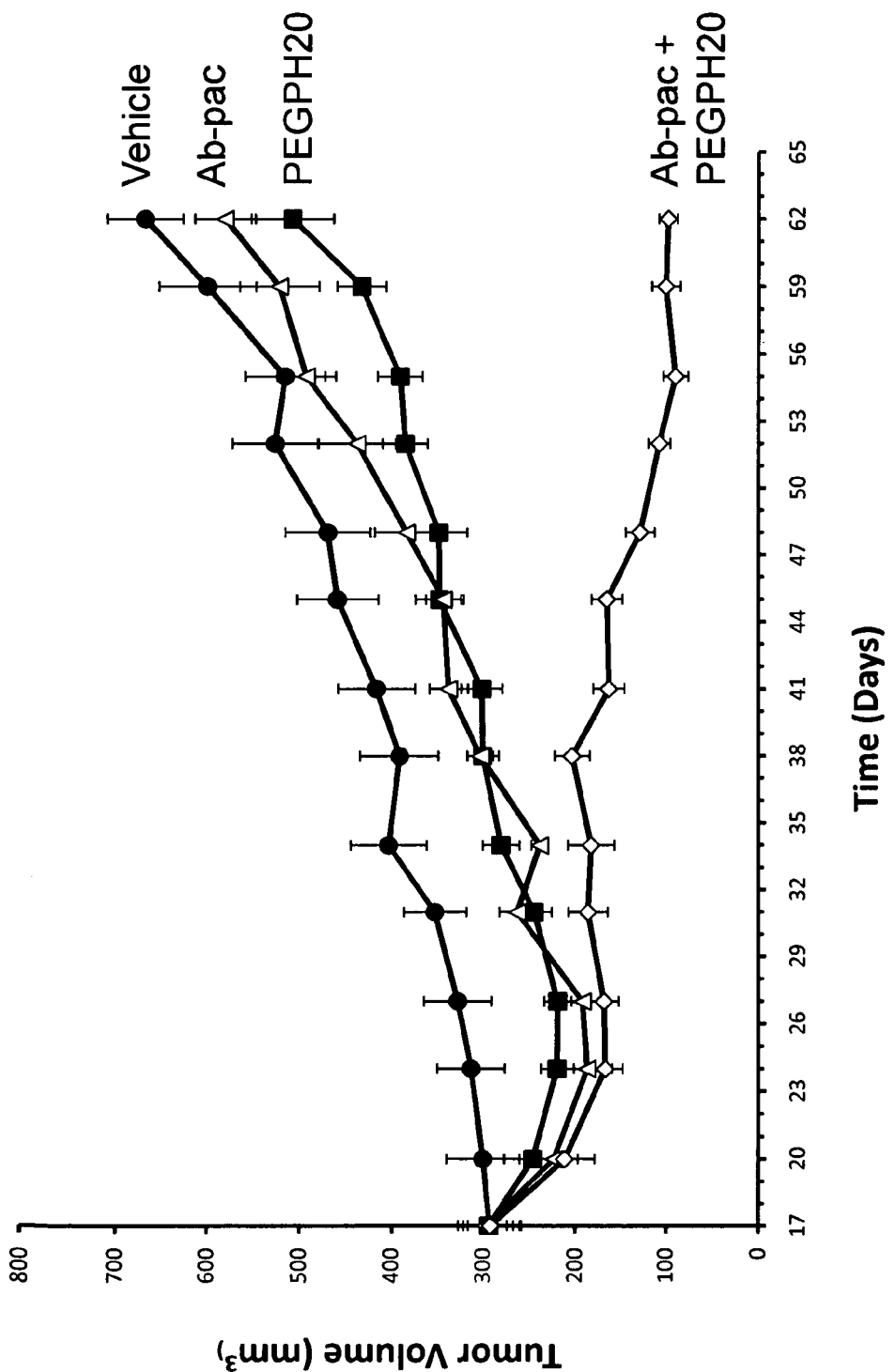
FIG. 6A depicts tumor growth inhibition in mice treated with vehicle, paclitaxel conjugated to albumin (Ab-pac), PEGPH20, or Ab-pac and PEGPH20 in the MDA-MB-468/HAS3 tumor model.
Figure 6B:
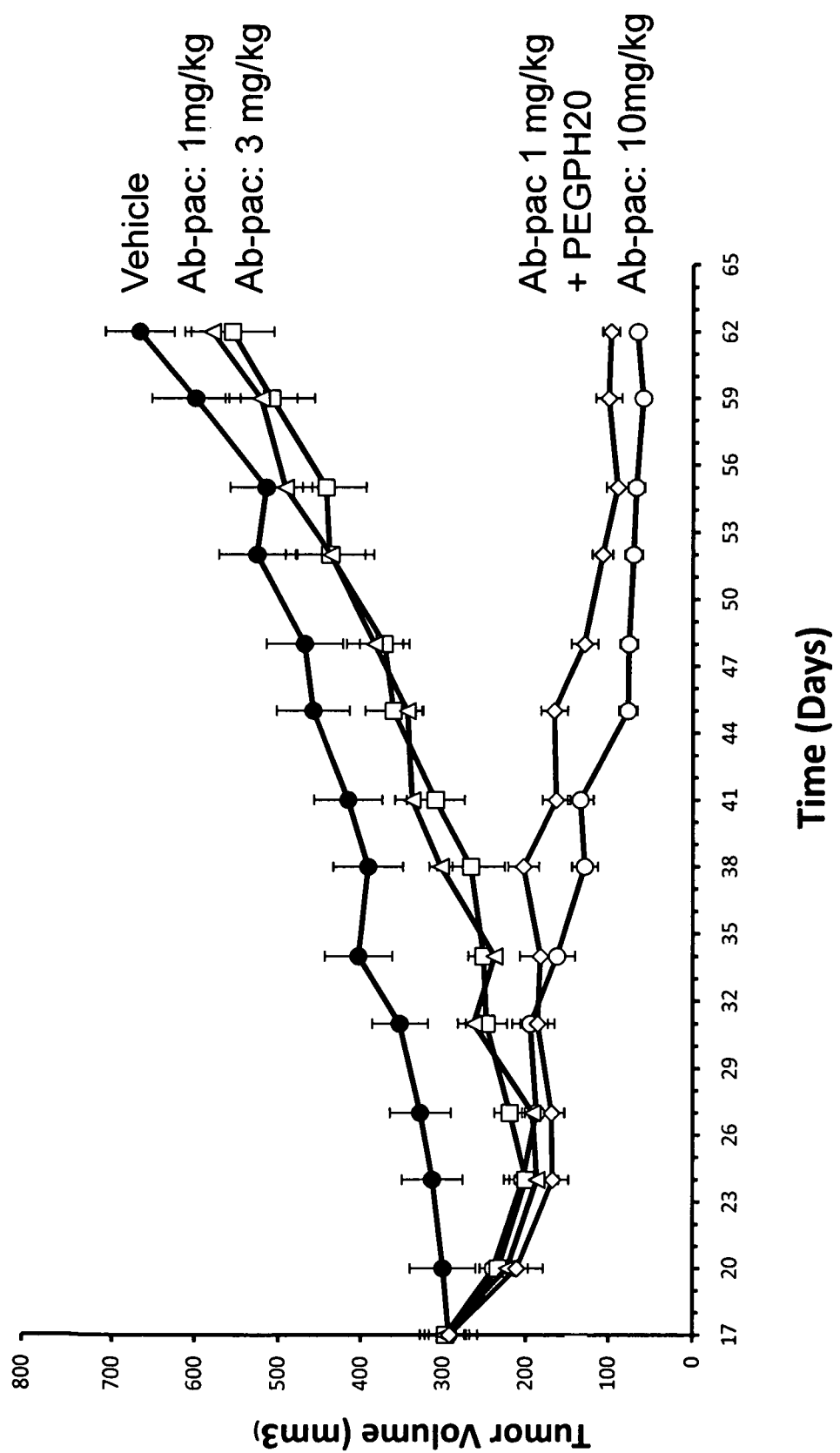
FIG. 6B depicts tumor growth inhibition in mice treated with vehicle, paclitaxel conjugated to albumin (Ab-pac) at 1 mg/kg, Ab-pac at 3 mg/kg, Ab-pac at 1 mg/kg and PEGPH20, or Ab-pac at 10 mg/kg in the MDA-MB-468/HAS3 tumor model.

The results are set forth in FIG. 6 (A-B). Animals in treatment group 1, receiving vehicle only, exhibited progressive tumor growth throughout the course of the study. On the final day of the study (day 62), the average tumor size had just over doubled in volume. The tumors of animals in treatment groups 2 and 3, receiving nab-paclitaxel at 1 or 3 mg/kg exhibited an initial (approximately 30%) decrease in tumor volume on days 17-27 post cell implantation (0-10 days post treatment), but then tumor growth resumed at a reduced rate compared to the vehicle control animals. On the final day of the study, the average tumor volume was just under twice the starting volume.

The pattern of tumor growth observed for PEGPH20-treated animals (group 5) was similar to that for groups 2 and 3, but the average tumor size for group 5 was slightly smaller than those for groups 2 and 3 on the final day. The average tumor size of the animals in group 4, which received 10 mg/kg nab-paclitaxel, followed the same trend as groups 2, 3, and 5 for the first 10 days after treatment (study days 17-27), but then remained at the reduced volume for an additional 11 days and then progressively decreased over the remainder of the study an additional 30% to yield an average tumor volume at the end of the study that was one-third the average starting tumor volume.

The combination of 1 mg/kg nab-paclitaxel and PEGPH20 (group 6) resulted in a substantial decrease in average tumor volume. These results show that there are synergistic effects upon treatment with the combination of nab-paclitaxel and PEGPH20, which results in a significantly improved efficacy on tumor growth inhibition compared to the individual treatments at the same dose. The combination therapy resulted in a similar decrease in tumor volume to that observed for animals receiving 10-fold greater nab-paclitaxel as a single therapy (10 mg/kg nab-paclitaxel (group 5)), which also yielded a final average tumor volume that was approximately one-third the average starting tumor volume.

Since modifications will be apparent to those of skill in the art, it is intended that this invention be limited only by the scope of the appended claims.

SEQUENCE LISTING (213 sequences)

SEQ ID NO: 1 - protein, 509 aa, Homo sapiens
  precursor human PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  Mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor PH20 1-482
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  PH20 36-481
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  PH20 36-480
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  PH20 36-479
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  PH20 36-478
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  PH20 36-477
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  Precursor cow PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  hyalurinidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  Precursor rabbit PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  Precursor Cynomolgus monkey PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  Precursor guinea pig PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  Precursor rat PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  Precursor mouse PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  hyaluronidase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes bacteriophage H4489A
  hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  PH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  PH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  PH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  PH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  PH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  PH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  PH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  PH20 mature 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  PH20 mature 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble rHuPH20 "precursor"
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  Gen2 mRNA sequence
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble rHuPH20 aa 431-447
DAFKLPPMETEEPQIFY

SEQ ID NO: 58 - protein, 16 aa, Homo sapiens
  C-terminal peptide cleaved from soluble rHuPH20 aa 431-446
DAFKLPPMETEEPQIF

SEQ ID NO: 59 - protein, 15 aa, Homo sapiens
  C-terminal peptide cleaved from soluble rHuPH20 aa 431-445
DAFKLPPMETEEPQI

SEQ ID NO: 60 - protein, 14 aa, Homo sapiens
  C-terminal peptide cleaved from soluble rHuPH20 aa 431-444
DAFKLPPMETEEPQ

SEQ ID NO: 61 - protein, 13 aa, Homo sapiens
  C-terminal peptide cleaved from soluble rHuPH20 aa 431-443
DAFKLPPMETEEP

SEQ ID NO: 62 - protein, 12 aa, Homo sapiens
  C-terminal peptide cleaved from soluble rHuPH20 aa 431-442
DAFKLPPMETEE

SEQ ID NO: 63 - protein, 520 aa, Ovis aries
  PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  precursor cow PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
  PH20
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
  encoding sheep PH20
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter sp.
  hyaluronan lyase (strain FB24)
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae 18RS21
  hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae serotype Ia
  hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae serotype III
  hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus (strain COL); identical to SEQ ID NO: 33
  hyaluronan lyase

SEQ ID NO: 75 - protein, 420 aa, Staphylococcus aureus (strain MRSA252)
  hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus (strain MRSA252)
  hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus (strain MSSA476)
  hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus (strain NCTC 8325); identical to SEQ ID NO: 33
  hyaluronan lyase

SEQ ID NO: 79 - protein, 809 aa, Staphylococcus aureus (strain bovine RF122)
  hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus (strain bovine RF122)
  hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus (strain USA300); identical to SEQ ID NO: 33
  hyaluronan lyase

SEQ ID NO: 82 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae (strain ATCC BAA-255/R6)
  hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae serotype 2 (strain D39/N)
  hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes serotype M1
  hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes serotype M2 (strain MGAS10)
  hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes serotype M4 (strain MGAS10)
  hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes serotype M6
  hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes serotype M12 (strain MGAS2)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes serotype M12 (strain MGAS2)
  hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes serotype M12 (strain MGAS9)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes serotype M28
  hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri (strain ATCC 700601 / ES114)
  hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus sp. (strain RCC307)
  hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 684 aa, Pedobacter heparinus
  chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis ATCC BAA-548
  chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 102 - protein, 512 aa, Macaca mulatta
  Precursor Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 103 - protein, 505 aa, Homo sapiens
  PH20 precursor 1-505
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 104 - protein, 503 aa, Homo sapiens
  PH20 precursor 1-503
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 105 - protein, 501 aa, Homo sapiens
  PH20 precursor 1-501
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 106 - protein, 499 aa, Homo sapiens
  PH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 107 - protein, 497 aa, Homo sapiens
  PH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 108 - protein, 495 aa, Homo sapiens
  PH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 109 - protein, 493 aa, Homo sapiens
  PH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 110 - protein, 491 aa, Homo sapiens
  PH20 precursor 1-491
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 111 - protein, 489 aa, Homo sapiens
  PH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 112 - protein, 490 aa, Homo sapiens
  PH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 113 - protein, 487 aa, Homo sapiens
  PH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 114 - protein, 485 aa, Homo sapiens
  PH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 115 - protein, 484 aa, Homo sapiens
  PH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 116 - protein, 476 aa, Homo sapiens
  PH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 117 - protein, 475 aa, Homo sapiens
  PH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 118 - protein, 474 aa, Homo sapiens
  PH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 119 - protein, 473 aa, Homo sapiens
  PH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 120 - protein, 472 aa, Homo sapiens
  PH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 121 - protein, 471 aa, Homo sapiens
  PH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 122 - protein, 470 aa, Homo sapiens
  PH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 123 - protein, 469 aa, Homo sapiens
  PH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 124 - protein, 468 aa, Homo sapiens
  PH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 125 - protein, 466 aa, Homo sapiens
  PH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 126 - protein, 465 aa, Homo sapiens
  PH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 127 - protein, 464 aa, Homo sapiens
  PH20 precursor 1-464
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 128 - protein, 462 aa, Homo sapiens
  PH20 precursor 1-462
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 129 - protein, 460 aa, Homo sapiens
  PH20 precursor 1-460
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 130 - protein, 458 aa, Homo sapiens
  PH20 precursor 1-458
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 131 - protein, 456 aa, Homo sapiens
  PH20 precursor 1-456
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 132 - protein, 454 aa, Homo sapiens
  PH20 precursor 1-454
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 133 - protein, 452 aa, Homo sapiens
  PH20 precursor 1-452
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 134 - protein, 450 aa, Homo sapiens
  PH20 precursor 1-450
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 135 - protein, 508 aa, Homo sapiens
  PH20 precursor 1-508
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 136 - protein, 506 aa, Homo sapiens
  PH20 precursor 1-506
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 137 - protein, 504 aa, Homo sapiens
  PH20 precursor 1-504
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 138 - protein, 502 aa, Homo sapiens
  PH20 precursor 1-502
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 139 - protein, 500 aa, Homo sapiens
  PH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 140 - protein, 498 aa, Homo sapiens
  PH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 141 - protein, 496 aa, Homo sapiens
  PH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 142 - protein, 494 aa, Homo sapiens
  PH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 143 - protein, 492 aa, Homo sapiens
  PH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 144 - protein, 488 aa, Homo sapiens
  PH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 145 - protein, 486 aa, Homo sapiens
  PH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 146 - protein, 472 aa, Homo sapiens
  mature PH20 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 147 - protein, 470 aa, Homo sapiens
  mature PH20 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 148 - protein, 468 aa, Homo sapiens
  mature PH20 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 149 - protein, 466 aa, Homo sapiens
  mature PH20 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 150 - protein, 464 aa, Homo sapiens
  mature PH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 151 - protein, 462 aa, Homo sapiens
  PH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 152 - protein, 460 aa, Homo sapiens
  PH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 153 - protein, 458 aa, Homo sapiens
  PH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 154 - protein, 456 aa, Homo sapiens
  PH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 155 - protein, 454 aa, Homo sapiens
  PH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 156 - protein, 455 aa, Homo sapiens
  PH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 157 - protein, 452 aa, Homo sapiens
  PH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 158 - protein, 450 aa, Homo sapiens
  PH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 159 - protein, 449 aa, Homo sapiens
  PH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 160 - protein, 441 aa, Homo sapiens
  PH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 161 - protein, 440 aa, Homo sapiens
  PH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 162 - protein, 439 aa, Homo sapiens
  PH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 163 - protein, 438 aa, Homo sapiens
  PH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 164 - protein, 437 aa, Homo sapiens
  PH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 165 - protein, 436 aa, Homo sapiens
  PH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 166 - protein, 435 aa, Homo sapiens
  PH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 167 - protein, 434 aa, Homo sapiens
  PH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 168 - protein, 433 aa, Homo sapiens
  PH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 169 - protein, 431 aa, Homo sapiens
  PH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 170 - protein, 430 aa, Homo sapiens
  PH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 171 - protein, 429 aa, Homo sapiens
  PH20 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 172 - protein, 427 aa, Homo sapiens
  PH20 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 173 - protein, 425 aa, Homo sapiens
  PH20 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 174 - protein, 423 aa, Homo sapiens
  PH20 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 175 - protein, 421 aa, Homo sapiens
  PH20 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 176 - protein, 419 aa, Homo sapiens
  PH20 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 177 - protein, 417 aa, Homo sapiens
  PH20 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 178 - protein, 415 aa, Homo sapiens
  PH20 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 179 - protein, 473 aa, Homo sapiens
  PH20 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 180 - protein, 471 aa, Homo sapiens
  PH20 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 181 - protein, 469 aa, Homo sapiens
  PH20 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 182 - protein, 467 aa, Homo sapiens
  PH20 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 183 - protein, 465 aa, Homo sapiens
  PH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 184 - protein, 463 aa, Homo sapiens
  PH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 185 - protein, 461 aa, Homo sapiens
  PH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 186 - protein, 459 aa, Homo sapiens
  PH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 187 - protein, 457 aa, Homo sapiens
  PH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 188 - protein, 453 aa, Homo sapiens
  PH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 189 - protein, 451 aa, Homo sapiens
  PH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 190 - DNA, 2105 bp, Bos taurus
  PH20 DNA
ggtttatctctgttcttggtgaggagacagacagaattgactgctgtgctcatccgcgagggtaaatgtgctcagctctttatggagtagtggagacgggcagagatgacaagatgaagcaacttgcaaaacattcctaaatacgaaggaagaagaatatttaaatgtaaatcatcattattcatttttatccatcaaagtggcttcattctgtgttcatatcttgcatcaaatattaggtacaccaaagcgtgtaggagaaaaaagtgcctttcacagtcatcgctctttgtgatgagaatgctgaggcgccaccatatctcctttcggagctttgctgggtctagcggaacaccccaggcagtgttcaccttccttctgcttccgtgttgtttggctctggacttcagagcaccccctcttatttcaaacacttctttcctctgggcctggaatgccccagttgaacgttgtgttaacagaagatttcaactacctccagatctgagactcttctctgtaaaaggaagcccccagaaaagtgctaccggacaatttattacattattttatgctgatagacttggctactatcctcatatagatgaaaaaacaggcaaaaccgtattcggaggaattccccagttgggaaacttaaaaagtcatatggagaaagcaaaaaatgacattgcctattacataccaaatgacagcgtgggcttggcggtcattgactgggaaaactggaggcctacctgggcaagaaactggaaacctaaagatgtttacagggatgagtcagttgagttggttctgcaaaaaaatccgcaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataatcataaccaacctacttacaatggaaattgccctgatgtagaaaaaaggagaaatgatgatctcgagtggttgtggaaggaaagcactgcccttttcccttctgtttatttgaatatcaggttaaaatctactcaaaatgctgccttgtatgttcgtaatcgtgtccaggaagccattcggttgtctaaaatagcgagtgtcgaaagtccacttccggtttttgtatatgcccgtccagtttttactgatgggtcttcaacatatctttctcagggtgaccttgtgaattcggttggtgagatcgtttctctaggtgcctctgggattataatgtggggcagtctcaatctaagcttatctatgcaatcttgcatgaacctaggcacttacttgaacactacactgaatccttacataatcaacgtcaccctagccgccaaaatgtgcagccaagtgctttgccacaatgaaggagtgtgtacaaggaaacactggaattcaagcgactatcttcacctgaacccaatgaattttgctattcaaactggggaaggtggaaaatacacagtacctgggacagtcacacttgaagacttgcaaaagttttctgatacattttattgcagttgttatgccaacatccactgtaagaagagagttgatataaaaaatgttcatagtgttaacgtgtgtatggcagaagacatttgtatagacagccctgtgaagttacaacccagtgatcattcctccagccaggaggcatctactaccaccttcagcagtatctcaccctccactacaactgccacagtatctccatgtactcctgagaaacactcccctgagtgcctcaaagtcaggtgttcggaagtcatccccaacgtcacccaaaaggcgtgtcaaagtgttaaattgaagaacatttcctatcagtcacctattcaaaatattaaaaatcaaacaacctattaaaattaaattcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaa

SEQ ID NO: 191 - DNA, 1971 bp, Bos taurus
  Hyal1 DNA
ttggtgcgcctggtgccagacttaaggaacagaatcttgctgatgcctgcacaggccctcgccctggggtcaggaagtttggagaatgaggcctttcagccttgaggtttccctacacctgccctgggctatggcagcccacttgcttcctgtctgcaccctgttcctgaacttgctcagcatgacccaaggctcccgggaccctgtggtccccaaccagcccttcactaccatctggaatgccaacaccgagtggtgtatgaagaaacacggcgtggacgtagacatcagtatctttgatgtggtgaccaacccggggcagaccttccgcggccctaacatgaccattttctacagctcccagctgggtacctacccttactatacatctgctggggagcctgtgtttggtggcctgccccagaatgccagcctgaatgcccacctggcccgcacattccaggacatcctggctgccatgcctgagcctcgcttctcagggctggcagtcattgactgggaggcatggcgcccgcgctgggccttcaactgggacaccaaggacatttaccggcagcgctcacgggcattggtacagaagcagcacccagactggctagctcctcgggtggaggccgcagctcaggaccagttcgagggggctgcagaggagtggatggcaggcaccctcaagctgggacaagcactgcgccctcagggcctctggggcttctataatttccctgagtgctacaactatgactttaaaagtcccaactatacaggccggtgtccactaaacatctgtgcccagaatgaccagctcgggtggctgtggggccagagccgtgccctctaccccagcatctacctgcctgcagcactggagggcacgaagaagacacagatgttcgtgcagcaccgtgtggctgaggcattccgtgtggcagcgggtgcgggggaccccaagctgccggtgctgccctacatgcagctcttctacgacatgactaaccactttctgcccgcggaggagctggagcacagcctgggggagagtgcagcccagggtgcagcgggagtggtgctctgggtgagctggctgagcacaagcaccaaggaatcatgccaggccatcaaggagtatgtggacacgacgctgggaccctccatcctgaatgtgaccagcggggctcgtctgtgcagtcaggtcctatgctccggccatggccgttgtgcccggcgccccagttaccccaaggcccgcctcatcctcaactccaccagtttttccatcaagcctacacctggtggtgggcccctgaccctacaaggtgccctctcgctcgaggatcggttgcggatggcagtggagttcgaatgtcgctgctaccgtgggtggagggggacacggtgtgagcagtggggcatgtggtgattggcatgggcacgcactgagtacctgatgcaagctgggcctggctaggtagggctttcccaagtccaggcagtcacaggagtcatggttacagtcagaagtccactcagccagtgtcatgagcatacaccagtgtgcacacctgcttacagaccaagatagctgcataaggacacggtgtgagcagtggggcatatgctgattggcatgggcacacactgagtacctgatgcaatctgggcctggctagggctttcccaagtccaggcagtcacaggagtcatggttaggcatccagtcacaggagtcatgtcaggcatcctgccgacagagtcaaaaatacttcctctggagacactgagtcagtcttcaaacagaagcagtcacaagcactgacattcgggacttccctggccatccagtggttaagacacggagcttccactgcagggggcacgggcagagactaagatcacgaatgctaagcggtgcggttaaacaaataacaaataaataaactgacattcactggg

SEQ ID NO: 192 - DNA, 1912 bp, Bos taurus
  Hyal2 DNA
caagtcgccggcgggctgcccaaagggcaggagctggcgcgaatagcttggctagagacttaccccgggaaggagggaggccgccgacctactgggccgacggactcccacacagttcctgagctggtgcctggcaggtgacactgacttcctgcagcccccagcatgtggacaggcctgggccccgccgtcacactggccctggtgttggtggtggcatgggccacggagctgaagcccacagcaccacccatcttcacgggccggccctttgtggtcgcatgggatgtgcccacacaggactgtggcccgcgccacaagatgccattggacccaaaggacatgaaggcctttgatgttcaggcttcacctaacgagggttttgtaaatcagaacatcaccatcttctaccgtgaccggctgggcatgtatccacacttcaattcggtggggaggtcagtacatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccatttggtagccattcgccaccctgattggccaccagagcgcgtagccaaggaggcgcagtatgagtttgagttcgctgcacggcagttcatgctggagacattgcgatttgtcaaggcgtttcggcctcggcacctatggggcttctacctcttccctgactgttacaaccatgattatgtgcagaactgggagacctatacaggccgctgccctgatgttgaggtctcccgaaatgaccagctggcctggctctgggccgagagcacggccctcttcccctctgtctacttggaagagacactggcttcctccactcacggccgcaactttgtcagctttcgtgtccaggaggctcttcgcgtggctgacgtccaccatgccaaccatgcactccccgtctacgtcttcacgaggcccacctatagccgtggactcacagggcttagcgagatggatctcatctccaccattggtgagagtgctgccctgggtgcagctggcgtcatcctctggggtgacgcagggtttaccaccagcaacgagacctgccgacgcctcaaggattatctgactcggtcattggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggaactcagttgggccgaccgcaaccacctacagatgcactttcgctgccagtgctacttaggctggggcggtgagcaatgccagtgggaccgcaggcgggcagctgggggtgccagtggggcctgggctgggtcccacctcactggcctgctggcagtggcagtcctggccttcacctagactttgtaagggtctctcacccagctgccacgccagctggcctctgccacaaggggtctgtcaggcatgtaggagcctgcaaggggtggacaaaccagagtctggaggggcagagccctctgggatgcctggtaggatgtccttaccagctcccaccccctgttctaagggggaggggcagtcccctggaaggccccgtctctccctgccagagaggaagaggggcacagctgggccggggaggacctgaccctactcccctgcccctggatagtttattattattattttggggtctcttttgtaaattaaatataaaacaact

SEQ ID NO: 193 - DNA, 1537 bp, Ovis aries
  Hyal2 DNA
gcaaatgacactgacttcctgcagcccccagcatgtggacaggcctgggccccgccgtcacactggccctggtgttggtggtggcatgggccacagagctgaagcccacagcaccacccatcttcacgggccggccctttgtggttgcatgggatgtgcccacacaggactgtggcccacgccacaagatgccattggacccaaaggacatgaaggcctttgatgtgcaggcctcacctaacgagggttttgtaaatcagaacatcaccatcttctaccgtgaccggctgggcatgtatccacacttcaactcggtggggaggtcagtccatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccagttggtggccagtcaccaccccgattggccaccagagcgcatagtcaaggaggcgcagtatgagtttgagttcgctgcacggcagttcatgctggagacactgcgatttgtcaaggcgtttcggcctcggcacctatggggcttctacctcttccctgactgttacaaccatgattatgtgcaaaactgggagacctatacaggccgctgccctgatgttgaggtctcccgaaatgaccagctgtcctggctctgggccgagagcacagccctcttcccctctgtctacctggaagagacgctggcttcctccactcacggccgcaactttgtcagctttcgtgtccaggaggctcttcgcgtggctgacgtccaccatgccaaccatgcactcccagtctacgtcttcacgaggcccacctacagccgtggactcacagggcttagcgagatggatctcatctccaccattggtgagagtgctgccctgggtgcagccggcgtcatcctctggggtgacgcagggtttaccaccagcaacgagacctgccgacgcctcaaggattatctgactcggtcactggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggagctcagttgggccgaccgcaaccacctacagacgcactttcgctgccagtgctacttaggctggggcggtgagcagtgccagtgggaccgcaggcgggcagctgggggtgccagtggggcctgggctgggtcccacctcactggcctgctggcagtggcagtcctggccttcacctggacttcgtaagggtctcacccagctgccaggccagctggcctctgccacaaggggtctgccaggcatgtagcagcccacaaggg

SEQ ID NO: 194 - DNA, 1967 bp, Ovis aries
  Hyaluronidase DNA
actcctgtttatctctgttcttggtgaggagacagacagaattgactgctgtgctcatccaccaggttacagatgaagcaacttgcaaaacattcctaaatacgaaggaagaagagtatttaaacgtaaatcatcattattcatttttatccatcaaagtagcttcattctgtgttcctatcttgcatcaaatattaggtaaaccaaagtgtgtaggagaaaaaagtgcttttcatagtcatcgctctttgtgaagagaatgctaaggcgccgccatatctcctttaggagctttgttggggccagtggaacaccccaggcggcgctcgccttccttctgcttccatgttggttggctctggacttcagagcaccccctcttatttcaaacacttctttcctctgggcctggaatgccccagctgaacgttgtgttaaaatctttaaactacctccagatctgagactcttctctgtaaaaggaagcccccaaaaaagtgctacgggacaatttattacattattttatgctgatagacttggctactatcctcatatagatgaaaaaacaggcaacaccgtatatggaggaattccccagttgggaaacttaaaaaatcatttggaaaaagccaaaaaagacattgcctattatataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttccggtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttattaagaaaaaaaaaaaaaaaaaaaaaaaaaaaa

SEQ ID NO: 195 - DNA, 2116 bp, Homo sapiens
  HAS1
cggagagaagagagagcccggccagacccactgcgatgagacagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttcaaaaaaaaaaaaaaaaaaaaaaaaaaaaa

SEQ ID NO: 196 - DNA, 3275 bp, Homo sapiens
  HAS2
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtt

SEQ ID NO: 197 - DNA, 4220 bp, Homo sapiens
  HAS3 transcript variant 1
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 198 - DNA, 1229 bp, Homo sapiens
  HAS3 transcript variant 2
ggaggggcatggagccgccgcgggcctgctgagctccggagcgcggcagccggcggcacgatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagcccccagggaaaggtatggcagtagaggatgaccaggtccaagctgcccaggtcagagctacggaagcatggtccgttcaccaacgccacgtttctagagagcagtgagctgattctccaatggtgagcaggggactacatgtgaactgggacctgcaggccaatgtatccctgaggaaaagtccacaagaacaattcaagaaactagtaagaaacaatgggcagaaagctgtgggacgaaagcacagcaggcttctgggaggctggagatcctttctctcaagggcaggattattcccacctgccacagttcacatgccacaaataacatctcaccttcagtcaagaaaaacgcaaaggaaaaaaaaaaaaaaaaaaaaaaaaaaaaaaaaaaaaaaaaaaaaaaaaaaaaaaaaaaaaaaaaaaaaaaa

SEQ ID NO: 199 - protein, 509 aa, Pan troglodyte
  Precursor chimpanzee PH20 XP_527873
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIVSILFLIISSVASL

SEQ ID NO: 200 - protein, 474 aa, Pan troglodyte
  mature chimpanzee PH20 XP_527873
LNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIVSILFLIISSVASL

SEQ ID NO: 201 - protein, 477 aa, Macaca mulatta
  mature Rhesus monkey PH20 EHH17639
LNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 202 - protein, 475 aa, Macaca fascicularis
  mature Cynomolgus monkey PH20 P38568.1
LNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 203 - protein, 518 aa, Bos taurus
  Mature cow PH20
LDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 204 - protein, 439 aa, Bos taurus
  mature cow PH20 AAP55713
LDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 205 - protein, 477 aa, Mus musculus
  Mature mouse PH20 NP_001073344.1
VDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 206 - protein, 477 aa, Rattus norvegicus
  Mature rat PH20 NP_446419.1
VDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 207 - protein, 510 aa, Oryctolagus cuniculus
  Mature rabbit PH20 NP_001076141.1
ANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 208 - protein, 494 aa, Cavia porcellus
  mature guinea pig PH20 NP_001166492.1
DKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 209 - protein, 540 aa, Vulpes vulpes
  Precursor Red Fox PH20
MGVLRFQNIFFRSFLGSSGTTQAVFIFLLIPRCLTQEFRAPPFIPNVSFLWGWNAPTELCAKRFNVQLDLNLFSLIGSPLKTVVGQGIAIFYADRLGYYPHINKTTGKHVNGGIPQLGSLKKHLDKAKKDISHYIETDSMGLAVIDWDSWRPNWARNWRPKHIYKEQSIDLAQQQHIHLNLTEVTQIAQADFEKAARCFMQETLKLGKFLRPNYLWGFYLYPDCYNYNYKNPNYNGSCYDIEERRNDEIDWLWKESTALFPSIYLKSKLKSSPFTALYVRNRVLEAIRVSKVKDIKHPLPIFVYARPVFTDVLLTYLTEDDLVNTIGESVSLGVSGIVMWGSLNLTENVQICTELDTYIKNKLNPYIINVTLAAKMCSQVLCQDEGVCIRKHWNSNDYLHLNPVNFAIQLERSGRYTVQGKPTLEDLQQFSKKFYCACYANTHCRERVDMTDIHTIKVCVGEDVCIDVYLNLVPSGHLPVWKGKYVTSSNIFSVMPPATGPPCVPGRDLNRCLKARFIVEDNSKTTQTGYQSIYIKNKKQ

SEQ ID NO: 210 - protein, 505 aa, Vulpes vulpes
  Mature Red Fox PH20 Q29152
QEFRAPPFIPNVSFLWGWNAPTELCAKRFNVQLDLNLFSLIGSPLKTVVGQGIAIFYADRLGYYPHINKTTGKHVNGGIPQLGSLKKHLDKAKKDISHYIETDSMGLAVIDWDSWRPNWARNWRPKHIYKEQSIDLAQQQHIHLNLTEVTQIAQADFEKAARCFMQETLKLGKFLRPNYLWGFYLYPDCYNYNYKNPNYNGSCYDIEERRNDEIDWLWKESTALFPSIYLKSKLKSSPFTALYVRNRVLEAIRVSKVKDIKHPLPIFVYARPVFTDVLLTYLTEDDLVNTIGESVSLGVSGIVMWGSLNLTENVQICTELDTYIKNKLNPYIINVTLAAKMCSQVLCQDEGVCIRKHWNSNDYLHLNPVNFAIQLERSGRYTVQGKPTLEDLQQFSKKFYCACYANTHCRERVDMTDIHTIKVCVGEDVCIDVYLNLVPSGHLPVWKGKYVTSSNIFSVMPPATGPPCVPGRDLNRCLKARFIVEDNSKTTQTGYQSIYIKNKKQ

SEQ ID NO: 211 - protein, 585 aa, Artificial Sequence [sequence omitted]

SEQ ID NO: 212 - DNA, 1662 bp, Homo sapiens
  HAS3 variant 1 cDNA
atgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctgtttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtag

SEQ ID NO: 213 - DNA, 10836 bp, Artificial Sequence
  pLV-EF1a-hHAS3-IRES-Hyg vector
aagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgatgcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgatatcctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctctagacccgggccaccatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctgtttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtagacgcgtctccggcctagggataacagggtaatccgctagcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacactagagatccaccggtcgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggcggccgcgtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgc

What is claimed:

1. A combination, comprising:
   a) a composition comprising a soluble PEGylated PH20 hyaluronidase; wherein the PH20 hyaluronidase comprises an amino acid sequence that has at least 95% sequence identity to the sequence set forth in SEQ ID NO: 4; and
   b) a composition comprising a tumor-targeted taxane that is nab-paclitaxel or nab-docetaxel.

2. The combination of claim 1, wherein:
   the compositions are formulated for direct administration;
   the concentration of hyaluronidase is sufficient to degrade tumor-associated hyaluronan; and
   the concentration of tumor-targeted taxane is sufficient to achieve intratumoral delivery of the taxane.

3. The combination of claim 1, wherein the concentration of tumor-targeted taxane is sufficient to reduce intratumoral nucleoside deaminase protein levels or protein activity compared to the levels or activity of the nucleoside deaminase in the absence of the intratumoral taxane formulation.

4. The combination of claim 1, wherein the hyaluronidase and tumor-targeted taxane are co-formulated for administration in a single composition.

5. The combination of claim 1, further comprising a composition comprising a nucleoside analog, or prodrug thereof, that is a chemotherapeutic agent.

6. The combination of claim 5, wherein:
the composition is formulated for direct administration; and
the concentration of nucleoside analog is sufficient to achieve intratumoral delivery.

7. The combination of claim 5, wherein the nucleoside analog or prodrug thereof is provided separately from the hyaluronidase and tumor-targeted taxane.

8. The combination of claim 5, wherein the nucleoside analog or prodrug thereof is co-formulated with one or both of the hyaluronidase and the tumor-targeted taxane.

9. The combination of claim 1, wherein the compositions are formulated for multiple dosage administration.

10. The combination of claim 1, wherein the compositions are formulated for single dosage administration.

11. The combination of claim 1, wherein:
the hyaluronidase composition contains between or about between 0.5 μg to 50 mg hyaluronidase conjugated to a polymer; or
the hyaluronidase composition contains between or about between 150 Units (U) to 60,000 U hyaluronidase conjugated to a polymer.

12. The combination of claim 11, wherein the volume of the composition containing the hyaluronidase is between or about between 0.5 mL to 100 mL.

13. The combination of claim 1, wherein the hyaluronidase is a PH20 that is a truncated human PH20, a bovine PH20 or an ovine PH20.

14. The combination of claim 1, wherein:
the hyaluronidase is a truncated human PH20;
the hyaluronidase is neutral active and soluble; and
the truncated PH20 comprises an amino acid sequence that contains a contiguous amino acid sequence, including at least amino acids 36-464 of SEQ ID NO:1 and terminates at a residue selected from 477, 478, 479, 480, 481, 482 or 483, or consists of an amino acid sequence that has at least 98% sequence identity to the polypeptide of SEQ ID NO:48.

15. The combination of claim 1, wherein the PH20 comprises the amino acid sequence set forth in any of SEQ ID NOS: 4-9, 47, 48, 150-170, 183-189, or an amino acid sequence that has at least 98% sequence identity to an amino acid sequence set forth in any of SEQ ID NOS: 4-9, 47, 48, 150-170, 183-189 and retains hyaluronidase activity.

16. The combination of claim 1, wherein:
the tumor-targeted taxane is formulated as a delivery vehicle selected from among a micelle, nanoparticle, microsphere, liposomes or hydrogel; and
the delivery vehicle is linked directly or indirectly to a tumor targeting moiety.

17. The combination of claim 1, wherein the tumor-targeted taxane composition contains a concentration of tumor-targeted taxane that is between or about between 0.01 mg taxane/mL to 100 mg/mL.

18. The combination of claim 17, wherein the volume of the composition comprising a tumor targeted taxane is between or about between 0.5 mL to 100 mL.

19. The combination of claim 5, wherein the nucleoside analog is a purine or pyrimidine analog or derivatives thereof.

20. The combination of claim 19, wherein the nucleoside analog is selected from among fluoropyrimidine 5-fluorouracil, 5-fluoro-2'-deoxycytidine, cytarabine, gemcitabine, troxacitabine, decitabine, Azacytidine, pseudoisocytidine, Zebularine, Ancitabine, Fazarabine, 6-azacytidine, capecitabine, $N^4$-octadecyl-cytarabine, elaidic acid cytarabine, fludarabine, cladribine, clofarabine, nelarabine, forodesine, and pentostatin, or derivatives thereof.

21. The combination of claim 5, wherein the nucleoside analog composition comprises a concentration of nucleoside analog that is between or about between 1 mg nucleoside analog/ml to 500 mg/ml, 5 mg/mL to 100 mg/ml, 10 mg/mL to 50 mg/mL, 25 mg/mL to 200 mg/mL or 20 mg/mL to 100 mg/mL.

22. The combination of claim 21, wherein the volume of the composition comprising a nucleoside analog is between or about between 0.5 mL to 1000 mL.

23. The combination of claim 1, wherein the composition(s) is (are) formulated for administration orally, intravenously (IV), subcutaneously, intramuscularly, intratumorally, intradermally, topically, transdermally, rectally, intrathecally or sub-epidermally.

24. The combination of claim 1, wherein the PEGylation moiety is selected from among polyethylene glycols (PEGs) and methoxypolyethylene glycols (mPEGs).

25. The combination of claim 1, wherein the PEGylation moiety is selected from among methoxypolyethylene glycols (mPEGs).

26. The combination of claim 1, wherein the PEGylation moiety is a PEG, and the PEG is a branched or linear PEG.

27. The combination of claim 1, wherein the PEGylation moiety is produced by reaction with methoxy-poly(ethylene glycol)-succinimidyl butanoate (mPEG-SBA) (5 kDa); methoxy-poly(ethylene glycol)-succinimidyl butanoate (mPEG-SBA) (20 kDa); methoxy-poly(ethylene glycol)-succinimidyl butanoate (mPEG-SBA) (30 kDa); methoxy-poly(ethylene glycol)-succinimidyl α-methylbutanoate (mPEG-SMB) (20 kDa); methoxy-poly(ethylene glycol)-succinimidyl α-methylbutanoate (mPEG-SMB) (30 kDa); methoxy-poly(ethylene glycol)-butyraldehyde (mPEG-butyraldehyde) (30 kDa), methoxy -poly(ethylene glycol)-succinimidyl propionate (mPEG-SPA) (20 kDa); methoxy -poly(ethylene glycol)-succinimidyl propionate (mPEG-SPA) (30 kDa); (methoxy -poly(ethylene glycol)) $_2$-N-hydroxysuccinimide ester (mPEG$_2$-NHS) (10 kDa branched); methoxy-poly(ethylene glycol)) $_2$-N-hydroxysuccinimide ester (mPEG$_2$-NHS) (20 kDa branched); (methoxy-poly (ethylene glycol)) $_2$-N-hydroxysuccinimide ester (mPEG$_2$-NHS) 40 kDa branched); (methoxy-poly(ethylene glycol)) $_2$-N-hydroxysuccinimide ester (mPEG$_2$-NHS) (60 kDa branched); biotin-poly(ethylene glycol)-N-hydroxysuccinimide ester (biotin-PEG-NHS) (5 kDa biotinylated); poly (ethylene glycol)-p-nitrophenyl carbonate (PEG-p-nitrophenyl-carbonate) (30 kDa); or poly(ethylene glycol)-priopionaldehyde (PEG-propionaldehyde) (30 kDa).

28. The combination of claim 1 that is packaged as a kit and optionally includes instructions for use.

29. The combination of claim 5, wherein the soluble PH20 hyaluronidase consists of the amino acid sequence set forth in any of SEQ ID NOS: 4-9, 47, 48, 150-170, 183-189, or an amino acid sequence that exhibits at least 98% sequence identity to an amino acid sequence set forth in SEQ ID NO: 4.

30. The combination of claim 5, wherein the PEGylation moiety is a polyethylene glycol (PEG).

31. The combination of claim 5, wherein the nucleoside analog is gemcitabine or a derivative thereof.

32. The combination of claim 1, wherein the hyaluronidase composition contains between or about between 50 Units hyaluronidase activity (U)/ml to 15,000 U/mL.

33. The combination of claim 5, wherein the nucleoside analog is a substrate for a nucleoside deaminase, and the nucleoside deaminase is adenosine deaminase or cytidine deaminase.

34. The combination of claim 1, comprising:
   a) a composition comprising PEGylated soluble PH20 hyaluronidase; and
   b) a composition comprising a tumor-targeted taxane that is nab-paclitaxel.

35. The combination of claim 1, wherein:
   the soluble PH20 consists of an amino acid sequence that has 98% sequence identity to residues 36-483 of SEQ ID NO:1; and
   the albumin-conjugated taxane is Nab-paclitaxel.

\* \* \* \* \*

UNITED STATES PATENT AND TRADEMARK OFFICE
CERTIFICATE OF CORRECTION

PATENT NO. : 9,913,822 B2
APPLICATION NO. : 13/815804
DATED : March 13, 2018
INVENTOR(S) : Maneval et al.

Page 1 of 2

It is certified that error appears in the above-identified patent and that said Letters Patent is hereby corrected as shown below:

On the Title Page

In Item (56) References Cited, in the list of OTHER PUBLICATIONS at page 7, Column 2, Line 38, please insert --(2006)--;

In Item (56) References Cited, in the list of OTHER PUBLICATIONS at page 11, Column 2, Line 21, please replace "aAt" with —At—;

In Item (56) References Cited, in the list of OTHER PUBLICATIONS at page 15, Column 2, Line 44, please replace "dated Oct. 24, 2017" with —received Oct. 24, 2017—;

In Item (56) References Cited, in the list of OTHER PUBLICATIONS at page 15, Column 2, Line 47, please replace "dated Nov. 7, 2017" with —received Nov. 7, 2017—.

In the Specification

At Column 11, Line 9, please replace "differentthan" with —different than—;

At Column 16, Line 29, please replace "*Bellovibrio*" with —*Bdellovibrio*—;

At Column 18, Line 40, please replace "esPH20is" with —esPH20 is—;

At Column 21, Line 25, please replace "difluororodeoxycytidine" with —difluorodeoxycytidine—;

At Column 45, Line 32, please replace "Chem" with —Cherr—;

At Column 47, Line 11, please replace "Hirudimidae" with —Hirudinidae—;

At Column 49, Line 3, please replace "113and" with —113 and—;

Signed and Sealed this
Second Day of October, 2018

Andrei Iancu
*Director of the United States Patent and Trademark Office*

CERTIFICATE OF CORRECTION (continued)
U.S. Pat. No. 9,913,822 B2

At Column 70, Line 26, please replace "H is" with —His—;

At Column 129, Line 16, please replace "microliter" with —microtiter—.

In the Claims

At Column 135, Line 20 to Line 24, should read:
35. The combination of claim 1, wherein:
the soluble PH20 consists of an amino acid sequence that has 98% sequence identity to residues 36-483 of SEQ ID NO: 1; and
the tumor-targeted taxane is an albumin-conjugated taxane that is Nab-paclitaxel.